United States Patent 12,508,308 (INFLUENZA mRNA VACCINES) - sequence listing, part 49

SEQ ID NO: 190340 - RNA, 1701 nt, Artificial Sequence
  derived and/or modified sequence opt5 from hemagglutinin__InfluenzaA__AEO01216
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaguggagaaucugaacaaaaaggucgacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccguuaaaaacggcaccuacgacuauccuaaguacagcgaagaggcuaaacugaauagagaggaaauugauggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 190341 - RNA, 1701 nt, Artificial Sequence; identical to SEQ ID NO: 186046
  derived and/or modified sequence opt5 from hemagglutinin__InfluenzaA__AEO01217

SEQ ID NO: 190342 - RNA, 1701 nt, Artificial Sequence; identical to SEQ ID NO: 186046
  derived and/or modified sequence opt5 from hemagglutinin__InfluenzaA__AEO01218

SEQ ID NO: 190343 - RNA, 1701 nt, Artificial Sequence; identical to SEQ ID NO: 186046
  derived and/or modified sequence opt5 from hemagglutinin__InfluenzaA__AEO01219

SEQ ID NO: 190344 - RNA, 1701 nt, Artificial Sequence; identical to SEQ ID NO: 185784
  derived and/or modified sequence opt5 from hemagglutinin__InfluenzaA__AEO01220

SEQ ID NO: 190345 - RNA, 1701 nt, Artificial Sequence; identical to SEQ ID NO: 185693
  derived and/or modified sequence opt5 from hemagglutinin__InfluenzaA__AEO01221

SEQ ID NO: 190346 - RNA, 1701 nt, Artificial Sequence; identical to SEQ ID NO: 185693
  derived and/or modified sequence opt5 from hemagglutinin__InfluenzaA__AEO01222

SEQ ID NO: 190347 - RNA, 1701 nt, Artificial Sequence; identical to SEQ ID NO: 186046
  derived and/or modified sequence opt5 from hemagglutinin__InfluenzaA__AEO01223

SEQ ID NO: 190348 - RNA, 1701 nt, Artificial Sequence
  derived and/or modified sequence opt5 from hemagglutinin__InfluenzaA__AEO01224
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaccgaacgcaacgcugggucuggaaucauuaucuccgauacacccguccaugacugcaauaccaccugucaaacaccuaaaggcgccaucaacacgagccuccccuuccagaauauucacccgaucaccauuggcaagugcccuaaguaugugaaaucuacaaagcugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaucugaaaagcacccagaacgccaucgacgagauuacgaauaaggucaacuccgugaucgagaaaaugaauacacaguuuaccgcuguuggaaaggaguucaaccaccuugagaagagaauugaaaaucugaacaaaaagguggaugacggcuuccucgauaucuggaccuacaaugccgagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacgcggaucuaucaaauucuggccaucuacuccaccguggcgagcucccucguccuggugguuucucugggcgcuauuagcuuuuggaugugcuccaacggaucucuccagugccgcaucuguauuuga

SEQ ID NO: 190349 - RNA, 1701 nt, Artificial Sequence
  derived and/or modified sequence opt5 from hemagglutinin__InfluenzaA__AEO01225
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggaccguuguggaacccggagacaagauuacguucgaggccacaggcaaccugguggucccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguauguuaaaucuaccaagcucagacuggcuacagggcuucggaacgugcccagcauccagucccgcggacuguuuggcgccauugccggguucaucgagggaggcuggaccgggauggucgacggaugguacggcuaucaucaccagaaugaacaaggcucuggguacgcugcggaucucaaaagcacacagaacgccaucgacgagauuaccaauaaggugaacuccguuaucgagaaaaugaauacgcaguuuacagcugugggaaaggaguucaaccaccuggagaagagaauugaaaaucuuaacaaaaaggucgaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugccaaggaaauugggaacggauguuuugaguucuaucacaagugcgacaauacauguauggaauccguuaaaaacggcaccuacgauuauccuaaguacagcgaggaagcuaaacucaauagagaggagaucgacggggugaagcuggaaucuacacggaucuaucaaauucuugccaucuacuccacggucgcgagcucccuggugcucguugugucucugggcgcuauuagcuuuuggaugugcuccaacggaucucugcagugccgcaucuguauuuga

SEQ ID NO: 190350 - RNA, 1701 nt, Artificial Sequence
  derived and/or modified sequence opt5 from hemagglutinin__InfluenzaA__AEO01226
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgaugggucuggaaucauuaucuccgacacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgagggaggcuggaccgggaugguggauggaugguacggcuaucaucaccagaaugaacaaggcucuggguacgccgcugaccugaaaagcacacagaacgcgaucgaugagauuaccaauaaggucaacuccgugaucgagaaaaugaauacgcaguuuacagccguuggaaaggaguucaaccaccuugagaagagaauugaaaaucugaacaaaaagguggacgauggcuuccucgacaucuggaccuacaaugcugagcugcugguccuccuggaaaacgagcggacccuugauuaucaugacagcaaugugaaaaaccuguacgagaagguccgcucucagcucaaaaacaaugccaaggaaauugggaacggauguuuugaguucuaucacaagugcgauaauacauguauggaauccgugaaaaacggcaccuacgacuauccuaaguacagcgaggaagccaaacugaauagagaggagaucgaugggguuaaacuugaaucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 190351 - RNA, 1701 nt, Artificial Sequence; identical to SEQ ID NO: 187860
  derived and/or modified sequence opt5 from hemagglutinin__InfluenzaA__AEO01227

SEQ ID NO: 190352 - RNA, 1701 nt, Artificial Sequence; identical to SEQ ID NO: 185693
  derived and/or modified sequence opt5 from hemagglutinin__InfluenzaA__AEO01228

SEQ ID NO: 190353 - RNA, 1701 nt, Artificial Sequence; identical to SEQ ID NO: 185693
  derived and/or modified sequence opt5 from hemagglutinin__InfluenzaA__AEO01229

SEQ ID NO: 190354 - RNA, 1701 nt, Artificial Sequence
  derived and/or modified sequence opt5 from hemagglutinin__InfluenzaA__AEO01230
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcaaggaggcuaaacugaaucgggaagagaucgacgggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 190355 - RNA, 1701 nt, Artificial Sequence; identical to SEQ ID NO: 185693
  derived and/or modified sequence opt5 from hemagglutinin__InfluenzaA__AEO01231

SEQ ID NO: 190356 - RNA, 1701 nt, Artificial Sequence; identical to SEQ ID NO: 186046
  derived and/or modified sequence opt5 from hemagglutinin__InfluenzaA__AEO01232

SEQ ID NO: 190357 - RNA, 1701 nt, Artificial Sequence; identical to SEQ ID NO: 185693
  derived and/or modified sequence opt5 from hemagglutinin__InfluenzaA__AEO01233

SEQ ID NO: 190358 - RNA, 1701 nt, Artificial Sequence; identical to SEQ ID NO: 185693
  derived and/or modified sequence opt5 from hemagglutinin__InfluenzaA__AEO01234

SEQ ID NO: 190359 - RNA, 1701 nt, Artificial Sequence; identical to SEQ ID NO: 185693
  derived and/or modified sequence opt5 from hemagglutinin__InfluenzaA__AEO01235

SEQ ID NO: 190360 - RNA, 1701 nt, Artificial Sequence; identical to SEQ ID NO: 189565
  derived and/or modified sequence opt5 from hemagglutinin__InfluenzaA__AEO01236

SEQ ID NO: 190361 - RNA, 1701 nt, Artificial Sequence; identical to SEQ ID NO: 185693
  derived and/or modified sequence opt5 from hemagglutinin__InfluenzaA__AEO01237

SEQ ID NO: 190362 - RNA, 1701 nt, Artificial Sequence; identical to SEQ ID NO: 185693
  derived and/or modified sequence opt5 from hemagglutinin__InfluenzaA__AEO01238

SEQ ID NO: 190363 - RNA, 1701 nt, Artificial Sequence; identical to SEQ ID NO: 185693
  derived and/or modified sequence opt5 from hemagglutinin__InfluenzaA__AEO01240

SEQ ID NO: 190364 - RNA, 1701 nt, Artificial Sequence; identical to SEQ ID NO: 186046
  derived and/or modified sequence opt5 from hemagglutinin__InfluenzaA__AEO01241

SEQ ID NO: 190365 - RNA, 1701 nt, Artificial Sequence; identical to SEQ ID NO: 185693
  derived and/or modified sequence opt5 from hemagglutinin__InfluenzaA__AEO01242

SEQ ID NO: 190366 - RNA, 1701 nt, Artificial Sequence
  derived and/or modified sequence opt5 from hemagglutinin__InfluenzaA__AEO01244
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggggcaggagggacgcaugaauuacuauuggacccugguugaacccggcgauaaaauuacguucgaggccacagggaaccugguggugccuagauacgcguuugccauggaacggaacgcuggaucuggcaucauuaucuccgacacccccguccaugauugcaauacaaccugucaaaccccuaagggcgccaucaacacaagccuccccuuccagaauauucacccgaucacgauugggaagugcccuaaauaugugaagucuaccaaacugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaccuuaagagcacacagaacgccaucgaugagauuaccaauaaagucaacuccgugaucgagaagaugaauacgcaguuuacagcuguuggcaaggaguucaaccaccuggagaaacgcauugaaaaucugaacaagaaaguggacgauggguuccucgacaucuggaccuacaaugccgagcugcugguccuccuggaaaacgagagaacccuugauuaucaugacagcaaugugaagaaccuguacgagaaaguccggucucagcucaagaacaaugccaaggaaauuggaaacggcuguuuugaguucuaucacaaaugcgauaauacauguauggaauccgugaagaacgggaccuacgacuauccuaaauacagcgaggaagcuaagcugaaucgcgaggagaucgauggcguuaaacuugaaucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 190367 - RNA, 1701 nt, Artificial Sequence; identical to SEQ ID NO: 185693
  derived and/or modified sequence opt5 from hemagglutinin__InfluenzaA__AEO01245

SEQ ID NO: 190368 - RNA, 1701 nt, Artificial Sequence
  derived and/or modified sequence opt5 from hemagglutinin__InfluenzaA__AEO01247
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaauccucauuuccgauacccccguccaugacugcaauacaaccugucaaaccccuaaaggcgccaucaacacaagccugcccuuccagaauauccacccgauuacgaucggcaagugcccuaaguaugugaaaucuaccaaacuuagacuggcuacagggcuccggaacguucccagcauucagucccgcggacuguuuggcgccaucgccggguucauugagggaggcuggaccgggaugguggacggaugguacggcuaucaucaccagaaugaacaaggcucuggguacgcugcggaucuuaagagcacacagcacgccaucgacgagaucaccaacaaggucaauuccgugauugagaaaaugaacacgcaguuuacagcuguuggaaaggaguucaaucaucuggagaagagaaucgaaaaccucaauaaaaagguggaugacggcuuccuggauauuuggaccuacaacgccgagcugcucguccugcuugaaaaugagcggacccuggacuaucacgauagcaacgugaaaaaucucuacgagaagguccgcucucagcugaaaaacaacgccaaggaaaucgggaauggauguuuugaguucuaucauaagugcgacaacacauguauggaauccgugaaaaauggcaccuacgauuauccuaaguacagcgaggaagcuaaacuuaacagagaggagauugacgggguuaagcuggaaucuacacggaucuaucaaauccucgccauuuacuccacgguggcgagcucccugguccuggugguuucucucggcgcuaucagcuuuuggaugugcuccaauggaucucugcagugccgcauuuguaucuga

SEQ ID NO: 190369 - RNA, 1701 nt, Artificial Sequence; identical to SEQ ID NO: 185693
  derived and/or modified sequence opt5 from hemagglutinin__InfluenzaA__AEO01248

SEQ ID NO: 190370 - RNA, 1701 nt, Artificial Sequence; identical to SEQ ID NO: 185693
  derived and/or modified sequence opt5 from hemagglutinin__InfluenzaA__AEO01249

SEQ ID NO: 190371 - RNA, 1701 nt, Artificial Sequence
  derived and/or modified sequence opt5 from hemagglutinin__InfluenzaA__AEO01250
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgaggacgcuuacguguucgugggcacauccagauauagcaagaaauuuaagccugagauugccauccggccgaaaguccgcgaucaggaagggagaaugaauuacuauuggacccugguugagcccggagacaagauuacguucgaagcuacaggcaaccugguggugccucgguacgccuuugcgauggagcgcaacgccgggucuggaaucauuaucuccgauacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgaaggaggcuggaccgggaugguggacggaugguacggcuaucaucaccagaaugagcaaggcucuggguacgccgcugaucugaaaagcacacagaacgcgaucgacgagauuaccaauaaggucaacuccgugaucgaaaagaugaauacgcaguuuacagccguuggaaaggaguucaaccaccuugaaaagagaauugagaaucugaacaaaaagguggaugacggcuuccucgauaucuggaccuacaaugcugaacugcugguccuccuggagaacgagcggacccuugacuaucaugauagcaaugugaaaaaccuguacgaaaagguccgcucucagcucaaaaacaaugccaaggagauugggaacggauguuuugaguucuaucacaagugcgacaauacauguauggaguccgugaaaaacggcaccuacgauuauccuaaguacagcgaagaggccaaacugaauagagaggaaaucgacgggguuaaacuugagucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 190372 - RNA, 1701 nt, Artificial Sequence; identical to SEQ ID NO: 187290
  derived and/or modified sequence opt5 from hemagglutinin__InfluenzaA__AEO01251

SEQ ID NO: 190373 - RNA, 1701 nt, Artificial Sequence; identical to SEQ ID NO: 185693
  derived and/or modified sequence opt5 from hemagglutinin__InfluenzaA__AEO01252

SEQ ID NO: 190374 - RNA, 1701 nt, Artificial Sequence; identical to SEQ ID NO: 185693
  derived and/or modified sequence opt5 from hemagglutinin__InfluenzaA__AEO01253

SEQ ID NO: 190375 - RNA, 1701 nt, Artificial Sequence
  derived and/or modified sequence opt5 from hemagglutinin__InfluenzaA__AEO01254
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaauaacaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaccuguacgagaaaguccgcucucagcucaagaauaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190376 - RNA, 1701 nt, Artificial Sequence; identical to SEQ ID NO: 186140
  derived and/or modified sequence opt5 from hemagglutinin__InfluenzaA__AEO01256

SEQ ID NO: 190377 - RNA, 1701 nt, Artificial Sequence; identical to SEQ ID NO: 189112
  derived and/or modified sequence opt5 from hemagglutinin__InfluenzaA__AEO01257

SEQ ID NO: 190378 - RNA, 1701 nt, Artificial Sequence; identical to SEQ ID NO: 185693
  derived and/or modified sequence opt5 from hemagglutinin__InfluenzaA__AEO01258

SEQ ID NO: 190379 - RNA, 1701 nt, Artificial Sequence; identical to SEQ ID NO: 190375
  derived and/or modified sequence opt5 from hemagglutinin__InfluenzaA__AEO01259

SEQ ID NO: 190380 - RNA, 1701 nt, Artificial Sequence; identical to SEQ ID NO: 188248
  derived and/or modified sequence opt5 from hemagglutinin__InfluenzaA__AEO01260

SEQ ID NO: 190381 - RNA, 1701 nt, Artificial Sequence
  derived and/or modified sequence opt5 from hemagglutinin__InfluenzaA__AEO01261
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagaauggcuacagggcuucggaacguucccagcauccagucccgcggacuguuuggcgccauugccggguucaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauagcaaugugaaaaaccuuuacgagaagguccgcucucagcugaaaaacaaugccaaggaaauugggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacaggcaucuaucaaauucuugccaucuacuccacgguggcgagcucccugguccucgugguuucucugggagcuauuagcuuuuggaugugcuccaacggcucucugcagugccggaucuguauuuga

SEQ ID NO: 190382 - RNA, 1701 nt, Artificial Sequence; identical to SEQ ID NO: 185693
  derived and/or modified sequence opt5 from hemagglutinin__InfluenzaA__AEO01262

SEQ ID NO: 190383 - RNA, 1701 nt, Artificial Sequence; identical to SEQ ID NO: 187375
  derived and/or modified sequence opt5 from hemagglutinin__InfluenzaA__AEO01263

SEQ ID NO: 190384 - RNA, 1701 nt, Artificial Sequence; identical to SEQ ID NO: 186046
  derived and/or modified sequence opt5 from hemagglutinin__InfluenzaA__AEO01264

SEQ ID NO: 190385 - RNA, 1701 nt, Artificial Sequence; identical to SEQ ID NO: 185693
  derived and/or modified sequence opt5 from hemagglutinin__InfluenzaA__AEO01265

SEQ ID NO: 190386 - RNA, 1701 nt, Artificial Sequence
  derived and/or modified sequence opt5 from hemagglutinin__InfluenzaA__AEO01266
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacgcccccguccaugauugcaauaccacaugucaaaccccuaaaggcgcuaucaacaccagccuccccuuccagaauauucacccgaucacaauugggaagugcccuaaguaugugaaaucuacgaagcugagacuugccaccggacugcggaacguucccagcauccagucccgcggccucuuuggggccauugcuggauucaucgagggcggguggacaggaaugguggacggcugguacggcuaucaucaccagaaugaacaagggucuggauacgcggccgaccugaaaagcacccagaacgcuaucgaugagauuacaaauaaggucaacuccgugaucgagaaaaugaauacccaguuuacggccguuggcaaggaguucaaccaccuugagaagagaauugaaaaucugaacaaaaagguggacgauggguuccucgacaucuggacauacaaugccgagcugcugguccuccuggaaaacgagcggacccuugauuaucaugacagcaaugugaaaaaccuguacgagaagguccgcucucagcucaaaaacaaugcuaaggaaauuggaaacggcuguuuugaguucuaucacaagugcgauaauaccuguauggaauccgugaaaaacgggacauacgacuauccuaaguacagcgaggaagccaaacugaauagagaggagaucgauggcguuaaacuugaaucuacccggaucuaucaaauucuggcgaucuacuccacaguggcuagcucccucguccuggugguuucucugggagccauuagcuuuuggaugugcuccaacggcucucuccagugccgcaucuguauuuga

SEQ ID NO: 190387 - RNA, 1701 nt, Artificial Sequence; identical to SEQ ID NO: 185693
  derived and/or modified sequence opt5 from hemagglutinin__InfluenzaA__AEO01267

SEQ ID NO: 190388 - RNA, 1701 nt, Artificial Sequence; identical to SEQ ID NO: 185693
  derived and/or modified sequence opt5 from hemagglutinin__InfluenzaA__AEO01268

SEQ ID NO: 190389 - RNA, 1701 nt, Artificial Sequence
  derived and/or modified sequence opt5 from hemagglutinin__InfluenzaA__AEO01269
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucgucauuuccgacacccccgugcaugauugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugaaggaggcuggaccgggauggucgacggaugguacggcuaucaucaccagaaugagcaaggcucuggguacgcugcggaccugaaaagcacacagaacgccaucgaugagaucaccaauaaggugaacuccguuauugaaaagaugaauacgcaguuuacagcugugggaaaggaguucaaccaccuugaaaagagaauggagaaucugaacaaaaaggucgacgauggcuuccucgacaucuggaccuacaaugccgaacugcuggugcuccuggagaacgagcggacccuugauuaucaugacagcaaugucaaaaaccuguacgaaaaggugcgcucucagcucaaaaacaaugccaaggagauugggaacggauguuuugaguucuaucacaagugcgauaauacauguauggaguccguuaaaaacggcaccuacgacuauccuaaguacagcgaagaggcuaaacugaauagagaggaaaucgauggggugaaacuugagucuacacggauuuaucaaauccuggccaucuacuccacggucgcgagcucccucgugcugguugugucucugggcgcuauuagcuuuuggaugugcuccaacggaucucuccagugccgcaucuguauuuga

SEQ ID NO: 190390 - RNA, 1701 nt, Artificial Sequence; identical to SEQ ID NO: 186857
  derived and/or modified sequence opt5 from hemagglutinin__InfluenzaA__AEO01270

SEQ ID NO: 190391 - RNA, 1701 nt, Artificial Sequence
  derived and/or modified sequence opt5 from hemagglutinin__InfluenzaA__AEO01271
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccccguccucugauaauggcacgugcuaucccggggacuuuauugauuacgaagaacugcgggagcagcuuagcuccgucagcucuuucgaacgcuuugagaucuucccuaagaccuccagcuggcccaaccacgacucuaauaagggagugacagccgcuuguccucaugccggcgcgaaauccuuuuauaagaaccugaucuggcucguuaaaaagggcaauagcuaccccaaacugucuaaguccuauauuaacgauaaggggaaagaagugcuuguccuguggggaauccaccacccuagcaccuccgccgaccaacagucucucuaccagaaugcugaugccuacguguucgugggcacaagcagauauuccaagaaauuuaagccggagauugcuauccggcccaaaguccgcgaccaggaggggagaaugaacuacuauuggacccugguugaaccuggagauaagauuacguucgaggccacaggcaaucugguggugccccgguacgcguuugccauggaacgcaacgcugggagcggaaucauuaucucugacaccccuguccaugacugcaacacaaccugucaaacccccaaaggcgccaucaauacaucccucccguuccagaacauucacccuaucacgauuggcaagugccccaaguaugugaaaagcaccaagcugagacuugcuacagggcugcggaauguuccuucuauccagagccgcggacucuuuggcgccauugccggguucaucgagggaggcuggaccgggaugguggauggaugguacggcuaucaucaccagaacgaacaaggcuccggguacgcugcggaccugaaaucuacacagcacgccaucgaugagauuaccaauaaggucaacagcgugaucgagaaaaugaauacgcaguuuacagcuguuggaaaggaguucaaccaucuugagaagagaauugaaaaucugaacaaaaagguggacgauggcuuccucgacaucuggaccuacaaugccgagcugcugguccuccuggaaaacgagcggacccuugauuaucacgacuccaaugugaaaaaccuguacgagaagguccgcagccagcucaaaaauaacgccaaggaaauugggaacggauguuuugaguucuaucauaagugcgauaauacauguauggaaucugugaaaaacggcaccuacgacuaucccaaguacuccgaggaagcuaaacugaauagagaggagaucgaugggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190392 - RNA, 1701 nt, Artificial Sequence; identical to SEQ ID NO: 185693
  derived and/or modified sequence opt5 from hemagglutinin__InfluenzaA__AEO01272

SEQ ID NO: 190393 - RNA, 1701 nt, Artificial Sequence; identical to SEQ ID NO: 185693
  derived and/or modified sequence opt5 from hemagglutinin__InfluenzaA__AEO01273

SEQ ID NO: 190394 - RNA, 1701 nt, Artificial Sequence; identical to SEQ ID NO: 185693
  derived and/or modified sequence opt5 from hemagglutinin__InfluenzaA__AEO01274

SEQ ID NO: 190395 - RNA, 1701 nt, Artificial Sequence; identical to SEQ ID NO: 187861
  derived and/or modified sequence opt5 from hemagglutinin__InfluenzaA__AEO01275

SEQ ID NO: 190396 - RNA, 1701 nt, Artificial Sequence
  derived and/or modified sequence opt5 from hemagglutinin__InfluenzaA__AEO01276
augaaggccauccuggugguccuccuguacaccuucgcuacagccaacgcggacacgcuuugcauuggcuaucacgcuaauaacagcaccgauacaguugacaccgugcugaaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggaacugcgggagcagcuuuccagcgucucuuccuucgagcgcuuugaaaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaggugcuuguccuguggggaauccaccaccccuccaccucugccgaucaacagagccucuaccagaacgcugacgccuacguguucgugggcacauccagauauagcaaaaaguuuaaaccugaaauugcuauccggccgaagguccgcgaucaggaggggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgaaauuaccaauaaagucaacuccgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccgaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190397 - RNA, 1701 nt, Artificial Sequence; identical to SEQ ID NO: 185693
  derived and/or modified sequence opt5 from hemagglutinin__InfluenzaA__AEO01277

SEQ ID NO: 190398 - RNA, 1701 nt, Artificial Sequence
  derived and/or modified sequence opt5 from hemagglutinin__InfluenzaA__AEO01278
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagcacgccaucgaugagauuaccaauaaggucaacuccgugaucgagaaaaugaauacgcaguuuacagcuguuggaaaggaguucaaccaucuugagaagagaauugccaaucugaacaaaaagguggacgauggcuuccucgacaucuggaccuacaaugccgaacugcugguccuccuggagaacgaacggacccuugauuaucacgacagcaaugugaaaaaccuguacgagaagguccgcucucagcucaaaaauaacgcuaaggagauugggaacggauguuuugaguucuaucauaagugcgauaauacauguauggaauccgugaaaaacggcaccuacgacuauccuaaguacagcgaagaggccaaacugaauagagaagagaucgaugggguuaaacuugagucuacacggaucuaucaaauucuggcgaucuacuccacgguggcuagcucccucguccuggugguuucucugggcgccauuagcuuuuggaugugcuccaacggaucucuccagugccgcaucuguauuuga

SEQ ID NO: 190399 - RNA, 1701 nt, Artificial Sequence
  derived and/or modified sequence opt5 from hemagglutinin__InfluenzaA__AEO01279
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaccgcugggucuggaaucauuaucuccgauacacccguccaugacugcaacaccaccugucaaacaccuaaaggcgccaucaauacgagccuccccuuccagaacauucacccgaucaccauuggcaagugcccuaaguaugugaaaucuacaaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacaagauuacgaacaaagucaauuccgugaucgagaagaugaacacacaguuuaccgcuguuggaaaggaguucaaucaccuugagaaaagaauugagaaccugaauaagaaaguggaugacggcuuccucgauaucuggaccuacaacgccgaacugcugguccuccuggagaaugaacggacacuugacuaucaugauagcaacgugaagaaucuguacgagaaaguccgcucucagcucaagaacaacgccaaggagauugggaauggauguuuugaguucuaucacaaaugcgacaacaccuguauggaauccgugaagaauggcacauacgauuauccuaaauacagcgaagaggcuaagcugaacagagaagagaucgacgggguuaaacuugagucuacgcggaucuaucaaauucuggccaucuacuccaccguggcgagcucccucguccuggugguuucucugggcgcuauuagcuuuuggaugugcuccaauggaucucuccagugccgcaucuguauuuga

SEQ ID NO: 190400 - RNA, 1701 nt, Artificial Sequence
  derived and/or modified sequence opt5 from hemagglutinin__InfluenzaA__AEO01282
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaagcuguacgagaaaguccgcucucagcucaagaacaacgccaaggaaauugggaauggauguuuugaguucuaucacaaaugcaacaauacauguauggaauccgugaagaacggcaccuacgacuauccuaaauacagcgaggaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190401 - RNA, 1701 nt, Artificial Sequence; identical to SEQ ID NO: 186795
  derived and/or modified sequence opt5 from hemagglutinin__InfluenzaA__AEO01283

SEQ ID NO: 190402 - RNA, 1701 nt, Artificial Sequence
  derived and/or modified sequence opt5 from hemagglutinin__InfluenzaA__AEO01284
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagcacgccauugacgagaucacaaacaaggucaauuccgugauugagaaaaugaacacccaguuuacggcuguuggaaaggaguucaaucaucuugagaagagaaucgaaaaccugaauaaaaagguggaugacggcuuccucgauauuuggacauacaacgccgagcugcugguccuccuggaaaaugagcggacccuugacuaucacgauagcaacgugaaaaaucuguacgagaagguccgcucucagcucaaaaacaacgccaaggaaaucgggaauggauguuuugaguucuaucauaagugcgacaacaccuguauggaauccgugaaaaauggcacauacgauuauccuaaguacagcgaggaagcuaaacugaacagagaggagaucaaugggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 190403 - RNA, 1701 nt, Artificial Sequence; identical to SEQ ID NO: 186794
  derived and/or modified sequence opt5 from hemagglutinin__InfluenzaA__AEO01285

SEQ ID NO: 190404 - RNA, 1701 nt, Artificial Sequence; identical to SEQ ID NO: 186887
  derived and/or modified sequence opt5 from hemagglutinin__InfluenzaA__AEO01286

SEQ ID NO: 190405 - RNA, 1701 nt, Artificial Sequence
  derived and/or modified sequence opt5 from hemagglutinin__InfluenzaA__AEO01287
augaaggccauccuggugguccuccuguacaccuucgcuacagccaacagcgacacgcuuugcauuggcuaucacgcgaauaacuccaccgauacaguugacaccgugcuggagaagaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 190406 - RNA, 1701 nt, Artificial Sequence; identical to SEQ ID NO: 186046
  derived and/or modified sequence opt5 from hemagglutinin__InfluenzaA__AEO01288

SEQ ID NO: 190407 - RNA, 1701 nt, Artificial Sequence; identical to SEQ ID NO: 185693
  derived and/or modified sequence opt5 from hemagglutinin__InfluenzaA__AEO01289

SEQ ID NO: 190408 - RNA, 1701 nt, Artificial Sequence
  derived and/or modified sequence opt5 from hemagglutinin__InfluenzaA__AEO01290
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccucucuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 190409 - RNA, 1701 nt, Artificial Sequence; identical to SEQ ID NO: 185693
  derived and/or modified sequence opt5 from hemagglutinin__InfluenzaA__AEO01291

SEQ ID NO: 190410 - RNA, 1701 nt, Artificial Sequence; identical to SEQ ID NO: 185693
  derived and/or modified sequence opt5 from hemagglutinin__InfluenzaA__AEO01292

SEQ ID NO: 190411 - RNA, 1701 nt, Artificial Sequence
  derived and/or modified sequence opt5 from hemagglutinin__InfluenzaA__AEO01294
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagcacgccaucgaugagauuaccaauaaggucaacuccgugaucgagaaaaugaauacgcaguuuacagcuguuggaaaggaguucaaccaucuugagaagagaauugaaaaucugaacaaaaagguggacgauggcuuccucgacaucuggaccuacaaugccgagcugcugguccuccuggaaaacgagcggacccuugauuaucacgacagcaaugugaaaaaccuguacgagaagguccgcucucagcucaaaaauaacgccaaggaaauugggaacggauguuuugaguucuaucauaagugcgauaauacauguauggaauccgugaaaaacggcaccuacgacuauccuaaguacagcgaggaagcuaaacugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190412 - RNA, 1701 nt, Artificial Sequence
  derived and/or modified sequence opt5 from hemagglutinin__InfluenzaA__AEO01295
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccauuauugcaacacaaccugucaaaccccuaaaggcgccaucaauacaucccuccccuuccagaacauucacccgaucacgauuggcaagugcccuaaguacgugaaaagcaccaagcugagacuugcuacagggcugcggaauguucccucuauccagagccgcggacucuuuggcgccauugccggguucaucgagggaggcuggaccgggaugguggacggaugguauggcuaccaucaccagaacgaacaaggcuccggguacgcugcggaccugaaaucuacacagaaugccaucgauaagauuaccaacaaagucaauagcgugaucgagaagaugaacacgcaguuuacagcuguuggaaaggaguucaaucaccuugagaaaagaauugagaaccugaauaagaaaguggacgauggcuuccucgacaucuggaccuauaacgccgaacugcugguccuccuggagaaugaacggacccuugauuaccaugacuccaacgugaagaaccuguaugagaaaguccgcagccagcucaagaauaacgccaaggagauugggaauggauguuuugaguucuaccacaaaugcgauaacacauguauggaaucugugaagaauggcaccuaugacuacccuaaauauuccgaagaggcuaagcugaacagagaagagaucgaugggguuaaacuugagagcacacggaucuaccaaauucuggccaucuacucuacgguggcguccagccucguccuggugguuucccugggcgcuauuucuuuuuggaugugcagcaauggaucccuccagugccgcaucuguauuuga

SEQ ID NO: 190413 - RNA, 1701 nt, Artificial Sequence; identical to SEQ ID NO: 185693
  derived and/or modified sequence opt5 from hemagglutinin__InfluenzaA__AEO01296

SEQ ID NO: 190414 - RNA, 1701 nt, Artificial Sequence; identical to SEQ ID NO: 187375
  derived and/or modified sequence opt5 from hemagglutinin__InfluenzaA__AEO01297

SEQ ID NO: 190415 - RNA, 1701 nt, Artificial Sequence; identical to SEQ ID NO: 187380
  derived and/or modified sequence opt5 from hemagglutinin__InfluenzaA__AEO01298

SEQ ID NO: 190416 - RNA, 1701 nt, Artificial Sequence; identical to SEQ ID NO: 185693
  derived and/or modified sequence opt5 from hemagglutinin__InfluenzaA__AEO01299

SEQ ID NO: 190417 - RNA, 1701 nt, Artificial Sequence; identical to SEQ ID NO: 185693
  derived and/or modified sequence opt5 from hemagglutinin__InfluenzaA__AEO01300

SEQ ID NO: 190418 - RNA, 1701 nt, Artificial Sequence; identical to SEQ ID NO: 185693
  derived and/or modified sequence opt5 from hemagglutinin__InfluenzaA__AEO01301

SEQ ID NO: 190419 - RNA, 1701 nt, Artificial Sequence; identical to SEQ ID NO: 185693
  derived and/or modified sequence opt5 from hemagglutinin__InfluenzaA__AEO01302

SEQ ID NO: 190420 - RNA, 1701 nt, Artificial Sequence; identical to SEQ ID NO: 187290
  derived and/or modified sequence opt5 from hemagglutinin__InfluenzaA__AEO01303

SEQ ID NO: 190421 - RNA, 1701 nt, Artificial Sequence
  derived and/or modified sequence opt5 from hemagglutinin__InfluenzaA__AEO01304
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaaggccagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaaggagugcuuguccuguggggcauccaccaccccuccacaucugcugaucaacagagccucuaccagaacgccgacgcuuacguguucguggggaccuccagauauagcaagaaauuuaagccugaaauugccauccggccgaaaguccgcgaucaggagggaagaaugaauuacuauuggacacugguugagcccggcgacaagauuaccuucgaagcgacggggaaccugguggugccucgguacgccuuugcuauggagcgcaacgccggaucuggcaucauuaucuccgauacacccguccaugacugcaauaccacaugucaaaccccuaaaggcgcuaucaacaccagccuccccuuccagaauauucacccgaucacaauugggaagugcccuaaguaugugaaaucuacgaagcugagacuugccaccggacugcggaacguucccagcauccagucccgcggccucuuuggggccauugcuggauucaucgaaggcggguggacaggaaugguggacggcugguacggcuaucaucaccagaaugagcaagggucuggauacgcggccgaucugaaaagcacccagaacgcuaucgacgaaauuacaaauaaggucaacuccgugaucgagaaaaugaauacccaguuuacggccguuggcaaggaguucaaccaccuugaaaagagaauugagaaucugaacaaaaagguggaugacggguuccucgauaucuggacauacaaugccgaacugcugguccuccuggagaacgaacggacccuugacuaucaugauagcaaugugaaaaaccuguacgagaagguccgcucucagcucaaaaacaaugcuaaggagauuggaaacggcuguuuugaguucuaucacaagugcgacaauaccuguauggaguccgugaaaaacgggacauacgauuauccuaaguacagcgaagaggccaaacugaauagagaagagaucgacggcguuaaacuugagucuacccggaucuaucaaauucuggcgaucuacuccacaguggcuagcucccucguccuggugguuucucugggagccauuagcuuuuggaugugcuccaacggcucucuccagugccgcaucuguauuuga

SEQ ID NO: 190422 - RNA, 1701 nt, Artificial Sequence
  derived and/or modified sequence opt5 from hemagglutinin__InfluenzaA__AEO01305
augaaggccauccuggugguccuccuguacaccuucgcuacagccagcgcggacacgcuuugcauuggcuaucacgcuaacaauuccaccgauacaguugacaccgugcuggagaagaacgugacagucacccauucugugaaucuccuggaagauaagcacaacgggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcacgugcuauccgggggauuuuauugacuacgaagaacugcgggagcagcuuagcucugucuccagcuucgaacgcuuugagaucuuccccaagaccucuuccuggccuaaccacgauagcaauaagggagugacagccgcuuguccccaugccggcgcgaaaucuuuuuauaagaaccugaucuggcucguuaaaaagggcaauuccuacccuaaacugagcaaguccuauauuaacgacaaggggaaagaagugcuuguccuguggggaauccaccaccccucuaccagcgccgaucaacagucccucuaccagaaugcugacgccuacguguucgugggcacaagcagauauucuaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccguccaugacugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauucuaacgugaaaaaucuguacgagaagguccgcucccagcucaaaaacaacgccaaggaaauugggaauggauguuuugaguucuaucacaagugcgacaacacauguauggaaagcgugaaaaauggcaccuacgauuauccuaaguacucugaggaagcuaaacugaacagagaggagaucgacgggguuaaacuugaauccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 190423 - RNA, 1701 nt, Artificial Sequence; identical to SEQ ID NO: 185693
  derived and/or modified sequence opt5 from hemagglutinin__InfluenzaA__AEO01306

SEQ ID NO: 190424 - RNA, 1701 nt, Artificial Sequence; identical to SEQ ID NO: 185693
  derived and/or modified sequence opt5 from hemagglutinin__InfluenzaA__AEO01307

SEQ ID NO: 190425 - RNA, 1701 nt, Artificial Sequence; identical to SEQ ID NO: 185693
  derived and/or modified sequence opt5 from hemagglutinin__InfluenzaA__AEO01308

SEQ ID NO: 190426 - RNA, 1701 nt, Artificial Sequence
  derived and/or modified sequence opt5 from hemagglutinin__InfluenzaA__AEO01309
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagcacgccauugacgagaucacaaacaaggucaauuccgugauugagaaaaugaacacccaguuuacggcuguuggaaaggaguucaaucaucuugagaagagaaucgaaaaccugaauaaaaagguggaugacggcuuccucgauauuuggacauacaacgccgagcugcugguccuccuggaaaaugagcggacccuugacuaucacgauagcaacgugaaaaaucuguacgagaagguccgcucucagcucaaaaacaacgccaaggaaaucgggaauggauguuuugaguucuaucauaagugcgacaacaccuguauggaauccgugaaaaauggcacauacgauuauccuaaguacagcaaagaggcuaagcugaacagagaagagaucaaugggguuaaacuugagucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 190427 - RNA, 1701 nt, Artificial Sequence
  derived and/or modified sequence opt5 from hemagglutinin__InfluenzaA__AEO01310
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacagagggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 190428 - RNA, 1701 nt, Artificial Sequence; identical to SEQ ID NO: 185693
  derived and/or modified sequence opt5 from hemagglutinin__InfluenzaA__AEO01311

SEQ ID NO: 190429 - RNA, 1701 nt, Artificial Sequence
  derived and/or modified sequence opt5 from hemagglutinin__InfluenzaA__AEO01312
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaucguggacggaugguacggcuaucaucaccagaaugaacaaggcucuggguacgcugcggaucugaaaagcacacagaacgccauugacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggauuuaucaaauccuggccauuuacuccacgguggcgagcucccucguccuggugguuucucugggcgcuaucagcuuuuggaugugcuccaacggaucucuccagugccgcauuuguaucuga

SEQ ID NO: 190430 - RNA, 1701 nt, Artificial Sequence; identical to SEQ ID NO: 186046
  derived and/or modified sequence opt5 from hemagglutinin__InfluenzaA__AEO01313

SEQ ID NO: 190431 - RNA, 1701 nt, Artificial Sequence; identical to SEQ ID NO: 186857
  derived and/or modified sequence opt5 from hemagglutinin__InfluenzaA__AEO01314

SEQ ID NO: 190432 - RNA, 1701 nt, Artificial Sequence
  derived and/or modified sequence opt5 from hemagglutinin__InfluenzaA__AEO01315
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaauagaaaacuuuguaagcugcgcgggguugcuccccuccaucugggaaaaugcaacaucgccggcuggauucuggggaauccugagugugaaucucucagcacagccuccucuuggagcuacaucguggagaccuccucuagcgacaacggaacgugcuauccgggcgauuuuauugacuacgaggagcugcgggagcagcuuuccagcgucucuuccuucgaaagauuugagaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaagugcuuguccugugggggauccaccaccccuccaccucugccgaucaacagagccucuaccagaacgcugacgccuacguguucgugggaacaucccgguauagcaagaaauuuaagccugagauugcuauccgcccgaaagucagagaucaggagggccggaugaauuacuauuggacccugguugaacccggggacaagauuacguucgaggccacaggaaaccugguggugccucgcuacgcguuugccauggaaagaaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugcggcuugcuacaggccugcgcaacguucccagcauccaguccagagggcucuuuggagccauugccggcuucaucgaagggggauggaccggcaugguggacgggugguacggauaucaucaccagaaugaacaaggcucuggcuacgcugcggaucugaaaagcacacagaacgccaucgacgagauuaccaauaaggucaacuccgugaucgagaaaaugaauacgcaguuuacagcuguugggaaggaguucaaccaccuugaaaagcggauugaaaaucugaacaaaaagguggaugacggauuccucgauaucuggaccuacaaugccgagcugcugguccuccuggaaaacgagcgcacccuugacuaucaugauagcaaugugaaaaaccuguacgagaaggucagaucucagcucaaaaacaaugccaaggaaauuggcaacggguguuuugaguucuaucacaagugcgacaauacauguauggaauccgugaaaaacggaaccuacgauuauccuaaguacagcgaggaagcuaaacugaaucgggaggagaucgacggcguuaaacuugaaucuacacgcaucuaucaaauucuggccaucuacuccacgguggcgagcucccucguccuggugguuucucugggggcuauuagcuuuuggaugugcuccaacggcucucuccagugcagaaucuguauuuga

SEQ ID NO: 190433 - RNA, 1701 nt, Artificial Sequence; identical to SEQ ID NO: 185693
  derived and/or modified sequence opt5 from hemagglutinin__InfluenzaA__AEO01316

SEQ ID NO: 190434 - RNA, 1701 nt, Artificial Sequence; identical to SEQ ID NO: 185693
  derived and/or modified sequence opt5 from hemagglutinin__InfluenzaA__AEO01317

SEQ ID NO: 190435 - RNA, 1701 nt, Artificial Sequence; identical to SEQ ID NO: 185693
  derived and/or modified sequence opt5 from hemagglutinin__InfluenzaA__AEO01318

SEQ ID NO: 190436 - RNA, 1701 nt, Artificial Sequence; identical to SEQ ID NO: 185693
  derived and/or modified sequence opt5 from hemagglutinin__InfluenzaA__AEO01319

SEQ ID NO: 190437 - RNA, 1701 nt, Artificial Sequence
  derived and/or modified sequence opt5 from hemagglutinin__InfluenzaA__AEO01321
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccuggcccugcucgaaaacgagcggacccuggacuaucaugauagcaaugucaaaaaccuuuacgagaaggugcgcucucagcugaaaaacaaugcuaaggaaaucgggaacggauguuuugaguucuaucacaagugcgacaauacauguauggaauccgucaaaaacggcaccuacgauuauccuaaguacagcgaggaagccaaacucaauagagaggagaucgacggggugaagcuggaaucuacacggauuuaucaaauccuugcgauuuacuccacgguugcuagcucccuggugcucgucgugucucugggcgccaucagcuuuuggaugugcuccaacggaucucugcagugccgcauuuguaucuga

SEQ ID NO: 190438 - RNA, 1701 nt, Artificial Sequence; identical to SEQ ID NO: 185693
  derived and/or modified sequence opt5 from hemagglutinin__InfluenzaA__AEO01322

SEQ ID NO: 190439 - RNA, 1701 nt, Artificial Sequence; identical to SEQ ID NO: 187375
  derived and/or modified sequence opt5 from hemagglutinin__InfluenzaA__AEO01323

SEQ ID NO: 190440 - RNA, 1701 nt, Artificial Sequence; identical to SEQ ID NO: 187290
  derived and/or modified sequence opt5 from hemagglutinin__InfluenzaA__AEO01324

SEQ ID NO: 190441 - RNA, 1701 nt, Artificial Sequence; identical to SEQ ID NO: 185693
  derived and/or modified sequence opt5 from hemagglutinin__InfluenzaA__AEO01325

SEQ ID NO: 190442 - RNA, 1701 nt, Artificial Sequence
  derived and/or modified sequence opt5 from hemagglutinin__InfluenzaA__AEO01326
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccaggacgcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190443 - RNA, 1701 nt, Artificial Sequence; identical to SEQ ID NO: 185693
  derived and/or modified sequence opt5 from hemagglutinin__InfluenzaA__AEO01327

SEQ ID NO: 190444 - RNA, 1701 nt, Artificial Sequence; identical to SEQ ID NO: 190402
  derived and/or modified sequence opt5 from hemagglutinin__InfluenzaA__AEO01328

SEQ ID NO: 190445 - RNA, 1701 nt, Artificial Sequence; identical to SEQ ID NO: 185693
  derived and/or modified sequence opt5 from hemagglutinin__InfluenzaA__AEO01330

SEQ ID NO: 190446 - RNA, 1701 nt, Artificial Sequence
  derived and/or modified sequence opt5 from hemagglutinin__InfluenzaA__AEO01331
augaaggccauccuggugguccuccuguacaccuucgcuacagccaacgcggacacgcuuugcauuggcuaucacgcuaauaacagcaccgauacaguugacacccugcucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauauuaaugacaaggggaaagaaguucuggugcucuggggaauccaccaccccuccaccucugccgaucaacagagccuguaccagaacgcugacgccuacgucuucgugggcacauccagauauagcaagaaauuuaagccugagauugcuauccggccgaaagugcgcgaucaggaggggagaaugaauuacuauuggacccuggucgaacccggagacaagauuacguucgaggccacaggcaaccucguugugccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacgugcccagcauccagucccgcggacuguuuggcgccauugccggguucaucgagggaggcuggaccgggaugguugacggaugguacggcuaucaucaccagaaugaacaaggcucuggguacgcugcggaucuuaagagcacacagaacgccaucgacgagauuaccaauaaggugaacuccgucaucgagaaaaugaauacgcaguuuacagcugugggaaaggaguucaaccaccuggagaagagaauugaaaaucucaacaaaaagguugaugacggcuuccuggauaucuggaccuacaaugccgagcugcucgugcugcuugaaaacgagcggacccuggacuaucaugauagcaaugucaaaaaccucuacgagaaggugcgcucucagcugaaaaacaaugccaaggaaauugggaacggauguuuugaguucuaucacaagugcgacaauacauguauggaauccgucaaaaacggcaccuacgauuauccuaaguacagcgaggaagcuaaacuuaauagagaggagaucgacggggugaagcuggaaucuacacggaucuaucaaauucucgccaucuacuccacgguugcgagcucccuggugcuggucgugucucucggcgcuauuagcuuuuggaugugcuccaacggaucucugcagugccgcaucuguauuuga

SEQ ID NO: 190447 - RNA, 1701 nt, Artificial Sequence
  derived and/or modified sequence opt5 from hemagglutinin__InfluenzaA__AEO01332
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggccuguccagauauagcaagaaauuuaagccugagauugcuauccggccgaaaguccgcgagcaggaagggagaaugaauuacuauuggacacugguugagcccggagauaagauuaccuucgaagccacgggcaaccucguggugccucgguacgcguuugccauggagcgcaacgcugggucuggaaucgucauuuccgacacacccgugcaugauugcaauaccacaugucaaaccccuaaaggcgccaucaacaccagccugcccuuccagaauauccacccgauuacaaucggcaagugcccuaaguauguuaaaucuacgaaacuuagacuggcuaccgggcuccggaacgugcccagcauucagucccgcggacuguuuggcgccaucgccggguucauugaaggaggcuggacagggauggucgacggaugguacggcuaucaucaccagaaugagcaaggcucuggguacgcugcggaccuuaaaagcacccagaacgccaucgaugagaucacaaauaaggugaacuccguuauugaaaagaugaauacccaguuuacggcugugggaaaggaguucaaccaccuggaaaagagaauggagaaucucaacaaaaaggucgacgauggcuuccuggacaucuggacauacaaugccgaacugcucgugcugcuugagaacgagcggacccuggauuaucaugacagcaaugucaaaaaccucuacgaaaaggugcgcucucagcugaaaaccaacgccaaggagauugggaauggauguuuugaguucuaucacaagugcgauaacacauguauggaguccguuaaaaauggcaccuacgacuauccuaaguacagcgaagaggcuaaacuuaacagagaggaaaucgauggggugaagcuggagucuacacggauuuaucaaauccucgccaucuacuccacggucgcgagcucccuggugcugguugugucucucggcgcuauuagcuuuuggaugugcuccaauggaucucugcagugccgcaucuguauuuga

SEQ ID NO: 190448 - RNA, 1701 nt, Artificial Sequence; identical to SEQ ID NO: 187861
  derived and/or modified sequence opt5 from hemagglutinin__InfluenzaA__AEO01333

SEQ ID NO: 190449 - RNA, 1701 nt, Artificial Sequence
  derived and/or modified sequence opt5 from hemagglutinin__InfluenzaA__AEO01334
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190450 - RNA, 1701 nt, Artificial Sequence; identical to SEQ ID NO: 187290
  derived and/or modified sequence opt5 from hemagglutinin__InfluenzaA__AEO01335

SEQ ID NO: 190451 - RNA, 1701 nt, Artificial Sequence
  derived and/or modified sequence opt5 from hemagglutinin__InfluenzaA__AEO01336
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcgagugcccuaaguauguuaagagcaccaaacugagacuugcuacagggcugcggaaugugcccucuauccagagccgcggacucuuuggcgccauugccggguucaucgaaggaggcuggaccgggaugguggacggaugguacggcuaucaucaccagaacgagcaaggcuccggguacgcugcggaucugaagucuacacagaaugccaucgacaaaauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 190452 - RNA, 1701 nt, Artificial Sequence
  derived and/or modified sequence opt5 from hemagglutinin__InfluenzaA__AEO01337
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaccagaaugaacaaggcucuggguaugcugcggaucugaaaagcacacagcaugccaucgacgagauuaccaacaaggucaauuccgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaccaugauagcaacgugaaaaaucuguaugagaagguccgcucucagcucaaaaacaacgccaaggaaauugggaauggauguuuugaguucuaccacaagugcgacaacacauguauggaauccgugaaaaauggcaccuaugauuacccuaaguauagcgaggaagcuaaacugaacagagaggagaucgacgggguuaaacuugaaucuacacggaucuaccaaauucuggccaucuauuccacgguggcgagcucccucguccuggugguuucucugggcgcuauuagcuuuuggaugugcuccaauggaucucuccagugccgcaucuguauuuga

SEQ ID NO: 190453 - RNA, 1701 nt, Artificial Sequence; identical to SEQ ID NO: 185693
  derived and/or modified sequence opt5 from hemagglutinin__InfluenzaA__AEO01338

SEQ ID NO: 190454 - RNA, 1701 nt, Artificial Sequence; identical to SEQ ID NO: 189565
  derived and/or modified sequence opt5 from hemagglutinin__InfluenzaA__AEO01339

SEQ ID NO: 190455 - RNA, 1701 nt, Artificial Sequence; identical to SEQ ID NO: 190411
  derived and/or modified sequence opt5 from hemagglutinin__InfluenzaA__AEO01340

SEQ ID NO: 190456 - RNA, 1701 nt, Artificial Sequence; identical to SEQ ID NO: 190411
  derived and/or modified sequence opt5 from hemagglutinin__InfluenzaA__AEO01341

SEQ ID NO: 190457 - RNA, 1701 nt, Artificial Sequence; identical to SEQ ID NO: 185693
  derived and/or modified sequence opt5 from hemagglutinin__InfluenzaA__AEO01342

SEQ ID NO: 190458 - RNA, 1701 nt, Artificial Sequence
  derived and/or modified sequence opt5 from hemagglutinin__InfluenzaA__AEO01343
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaccuguacgagaaaguccgcagccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 190459 - RNA, 1701 nt, Artificial Sequence
  derived and/or modified sequence opt5 from hemagglutinin__InfluenzaA__AEO01344
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccaaguauagcaaaaaguuuaaaccugagaucgcuauuagaccgaagguccgggaucaggaggggcgcaugaauuacuauuggacccucguugaacccggagacaaaaucacguucgaggccacaggcaaccugguggugccuagauacgcguuugccauggaacggaacgcugggucuggaauuaucaucuccgauacccccguccaugacugcaauacaaccugucaaaccccuaagggcgccauuaacacaagccugcccuuccagaauauccacccgauuacgaucggcaagugcccuaaauaugugaagucuaccaaacuccgccuggcuacagggcuuagaaacguucccagcauucagucccggggacuguuuggcgccaucgccggguucaucgagggaggcuggaccgggaugguggacggaugguacggcuaucaucaccagaaugaacaaggcucuggguacgcugcggaucucaagagcacacagaacgccauugacgagaucaccaauaaagucaacuccgugauugagaagaugaauacgcaguuuacagcuguuggaaaggaguucaaccaccuggagaaacgcaucgaaaaucuuaacaagaaaguggaugacggcuuccuggauauuuggaccuacaaugccgagcuccugguccugcucgaaaacgagagaacccuggacuaucaugauagcaaugugaagaaccuuuacgagaaaguccggucucagcugaagaacaaugccaaggaaaucgggaacggauguuuugaguucuaucacaaaugcgacaauacauguauggaauccgugaagaacggcaccuacgauuauccuaaauacagcgaggaagcuaagcucaaucgcgaggagaucgacgggguuaaacuggaaucuacaagaauuuaucaaauccuugccauuuacuccacgguggcgagcucccugguccucgugguuucucugggcgcuaucagcuuuuggaugugcuccaacggaucucugcagugccggauuuguaucuga

SEQ ID NO: 190460 - RNA, 1701 nt, Artificial Sequence; identical to SEQ ID NO: 189565
  derived and/or modified sequence opt5 from hemagglutinin__InfluenzaA__AEO01345

SEQ ID NO: 190461 - RNA, 1701 nt, Artificial Sequence; identical to SEQ ID NO: 185693
  derived and/or modified sequence opt5 from hemagglutinin__InfluenzaA__AEO01346

SEQ ID NO: 190462 - RNA, 1701 nt, Artificial Sequence
  derived and/or modified sequence opt5 from hemagglutinin__InfluenzaA__AEO01347
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcgagugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacaaaauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaagcuggaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190463 - RNA, 1701 nt, Artificial Sequence
  derived and/or modified sequence opt5 from hemagglutinin__InfluenzaA__AEO01348
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgagcaggaagggagaaugaauuacuauuggacacugguugagcccggagauaagaucaccuucgaagccacgggcaaccugguggugccucgguacgcguuugccauggagcgcaacgcugggucuggaauuaucaucuccgacacacccguccaugauugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgaaggaggcuggacagggaugguggacggaugguacggcuaucaucaccagaaugagcaaggcucuggguacgcugcggaccugaaaagcacccagaacgccauugaugagaucacaaauaaggucaacuccgugauugaaaagaugaauacccaguuuacggcuguuggaaaggaguucaaccaccuugaaaagagaaucgagaaucugaacaaaaagguggacgauggcuuccucgacauuuggacauacaaugccgaacugcugguccuccuggagaacgagcggacccuugauuaucaugacagcaaugugaaaaaccuguacgaaaagguccgcucucagcucaaaaacaaugccaaggagaucgggaacggauguuuugaguucuaucacaagugcgauaauaccuguauggaguccgugaaaaacggcacauacgacuauccuaaguacagcgaagaggcuaaacugaauagagaggaaaucgaugggguuaaacuugagucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 190464 - RNA, 1701 nt, Artificial Sequence
  derived and/or modified sequence opt5 from hemagglutinin__InfluenzaA__AEO01349
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgaaaacggcacgugcuauccgggggacuuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagccucuaccagaacgcugaugccuacguguucgugggcacauccagauauagcaagaaauuuaagccugagauugcuauccggccgaaaguccgcgaccaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaagaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaauccgugaaaaacggcaccuacgacuauccuaaguacagcaaagaagcuaagcugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190465 - RNA, 1701 nt, Artificial Sequence
  derived and/or modified sequence opt5 from hemagglutinin__InfluenzaA__AEO01350
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagcacgcgaucgacgagauuacgaacaaggucaauuccgugaucgagaaaaugaacacacaguuuaccgccguuggaaaggaguucaaucaucuugagaagagaauugaaaaccugaauaaaaagguggaugacggcuuccucgauaucuggaccuacaacgcugagcugcugguccuccuggaaaaugagcggacacuugacuaucacgauagcaacgugaaaaaucuguacgagaagguccgcucucagcucaaaaacaacgccaaggaaauugggaauggauguuuugaguucuaucauaagugcgacaacaccuguauggaauccgugaaaaauggcacauacgauuauccuaaguacagcgaggaagccaaacugaacagagaggagaucgacgggguuaaacuugaaucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 190466 - RNA, 1701 nt, Artificial Sequence; identical to SEQ ID NO: 185693
  derived and/or modified sequence opt5 from hemagglutinin__InfluenzaA__AEO01351

SEQ ID NO: 190467 - RNA, 1701 nt, Artificial Sequence; identical to SEQ ID NO: 186857
  derived and/or modified sequence opt5 from hemagglutinin__InfluenzaA__AEO01352

SEQ ID NO: 190468 - RNA, 1701 nt, Artificial Sequence
  derived and/or modified sequence opt5 from hemagglutinin__InfluenzaA__AEO01353
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuuuucugggcgcuauuucuuucuggaugugcagcaacggaucccuccagugccgcaucuguauuuga

SEQ ID NO: 190469 - RNA, 1701 nt, Artificial Sequence
  derived and/or modified sequence opt5 from hemagglutinin__InfluenzaA__AEO01354
augaaggccauccuggugguccuccuguacaaauucgcuaccgccaacgcggacacacuuugcauuggcuaucacgcuaauaacagcacggauaccguugacacagugcuggagaagaaugugaccgucacacauuccgugaaccuccuggaagauaaacacaaugggaagcuguguaaacugagaggaguugcgccccuccaucugggcaagugcaacaucgccggguggauucugggaaauccugagugugaaucucucagcaccgcuuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaaaggagugaccgccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccacaucugccgaucaacagagccucuaccagaacgcugacgccuacguguucgugggcaccuccagauauagcaaaaaguuuaaaccugagauugcuauccggccgaagguccgcgaucaggaggggagaaugaauuacuauuggacacugguugaacccggagacaaaauuaccuucgaggccacgggcaaccugguggugccucgguacgcguuugccauggaacgcaacgcugggucuggaaucauuaucuccgauacacccguccaugacugcaauaccacaugucaaaccccuaagggcgccaucaacaccagccuccccuuccagaauauucacccgaucacaauuggcaagugcccuaaauaugugaagucuacgaaacugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaucuuaagagcacccagaacgccaucgacgagauuacaaauaaagucaacuccgugaucgagaagaugaauacccaguuuacggcuguuggaaaggaguucaaccaccuugagaaaagaauugaaaaucugaacaagaaaguggaugacggcuuccucgauaucuggacauacaaugccgagcugcugguccuccuggaaaacgagcggacccuugacuaucaugauagcaaugugaagaaccuguacgagaaaguccgcucucagcucaagaacaaugccaaggaaauugggaacggauguuuugaguucuaucacaaaugcgacaauaccuguauggaauccgugaagaacggcacauacgauuauccuaaauacagcgaggaagcuaagcugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 190470 - RNA, 1701 nt, Artificial Sequence; identical to SEQ ID NO: 187113
  derived and/or modified sequence opt5 from hemagglutinin__InfluenzaA__AEO01355

SEQ ID NO: 190471 - RNA, 1701 nt, Artificial Sequence; identical to SEQ ID NO: 185693
  derived and/or modified sequence opt5 from hemagglutinin__InfluenzaA__AEO01356

SEQ ID NO: 190472 - RNA, 1701 nt, Artificial Sequence
  derived and/or modified sequence opt5 from hemagglutinin__InfluenzaA__AEO01358
augaaggccauccuggugguccuccuguacaccuucgcuacagccaacgcggacacgcuuugcguuggcuaucacgcuaauaacagcaccgauacaguggacaccgugcuggagaagaaugucacagugacccauuccguuaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauugucgagaccuccucuagcgacaacggcacgugcuauccgggggauuuuaucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgcccaugacugcaauacaaccugucaaaccccuaaaggcgcuaucaacacaagccuccccuuccagaauauccacccgauuacgaucggcaagugcccuaaguaugugaaaucuaccaagcugagacuugccacagggcugcggaacguucccagcauucagucccgcggacucuuuggcgccaucgcuggguucauugagggaggcuggaccgggaugguggacggaugguacggcuaucaucaccagaaugaacaaggcucuggguacgcggccgaucugaaaagcacacagaacgcuaucgacgagaucaccaauaaggucaacuccgugauugagaaaaugaauacgcaguuuacagccguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugcuaaggaaaucgggaacggauguuuugaguucuaucacaagugcgacaauacauguauggaauccgugaaaaacggcaccuacgauuauccuaaguacagcgaggaagccaaacugaauagagaggagauugacgggguuaaacuugaaucuacacggaucuaucaaauccuggcgauuuacuccacgguggcuagcucccucguccuggugguuucucugggcgccaucagcuuuuggaugugcuccaacggaucucuccagugccgcauuuguaucuga

SEQ ID NO: 190473 - RNA, 1701 nt, Artificial Sequence; identical to SEQ ID NO: 187113
  derived and/or modified sequence opt5 from hemagglutinin__InfluenzaA__AEO01359

SEQ ID NO: 190474 - RNA, 1701 nt, Artificial Sequence; identical to SEQ ID NO: 190446
  derived and/or modified sequence opt5 from hemagglutinin__InfluenzaA__AEO01360

SEQ ID NO: 190475 - RNA, 1701 nt, Artificial Sequence; identical to SEQ ID NO: 186046
  derived and/or modified sequence opt5 from hemagglutinin__InfluenzaA__AEO01361

SEQ ID NO: 190476 - RNA, 1701 nt, Artificial Sequence; identical to SEQ ID NO: 190446
  derived and/or modified sequence opt5 from hemagglutinin__InfluenzaA__AEO01362

SEQ ID NO: 190477 - RNA, 1701 nt, Artificial Sequence; identical to SEQ ID NO: 186857
  derived and/or modified sequence opt5 from hemagglutinin__InfluenzaA__AEO01363

SEQ ID NO: 190478 - RNA, 1701 nt, Artificial Sequence
  derived and/or modified sequence opt5 from hemagglutinin__InfluenzaA__AEO01365
augaaggccauccuggugguccuccuguacaccuucgcuacagccaacgcggacacgcuuugcauuggcuaucacgcuaauaacagcaccgauacaguugacaccgugcugaaaaagaaugugacagucacccauuccgugaacauccucgaggauaaacacaaugggaagcuguguaaacuuagaggaguugcgccccugcaucucggcaagugcaacauugccggguggauccugggaaauccugaaugugagucucugagcacagcuuccucuuggagcuacauuguggaaaccuccucuagcgacaacggcacgugcuauccgggggauuuuaucgacuacgaggaacuccgggagcagcuguccagcgucucuuccuucgagcgcuuugaaaucuuccccaagaccagcucuuggccuaaucacgauuccaacaaaggagugacagccgcuuguccccaugccggcgccaagagcuuuuauaaaaaucuuauuuggcugguuaagaaaggcaacucuuacccuaagcucuccaagagcuauaucaaugacaaagggaaggaggugcugguccuuuggggcauucaccaccccuccaccucugccgaucaacagagccuguaccagaacgcugacgccuacguguucgugggaacauccagauauagcaaaaaguuuaaaccugaaaucgcuauucggccgaagguccgcgaucaggaggggagaaugaauuacuauuggacccucguugagcccggagacaaaaucacguucgaagccacaggcaaccugguggugccucgguacgcguuugccauggagcgcucugcuggguccggaauuaucaucagcgauacccccguccaugacugcaacacaaccugucaaaccccuaagggcgccauuaauacaucucugcccuuccagaacauccacccgauuacgaucggcaagugcccuaaauaugugaaaagcaccaaacucagacuggcuacagggcuucggaauguucccuccauucagucucgcggacuguuuggcgccaucgccggguucaucgaaggaggcuggaccgggaugguggacggaugguacggcuaucaucaccagaacgagcaaggcagcggguacgcugcggaucucaaguccacacagaaugccauugacgaaaucaccaacaaagucaauagcgugauugagaagaugaacacgcaguuuacagcuguuggaaaggaguucaaucaccuggaaaagagaaucgagaaccuuaauaagaaaguggaugacggcuuccuggauauuuggaccuacaacgccgaacuccugguccugcucgagaaugaacggacccuggacuaucaugauucuaacgugaagaaucuuuacgagaaaguccgcucccagcugaagaacaacgccaaggagaucgggaauggauguuuugaguucuaucacaaaugcgacaacacauguauggaaagcgugaagaauggcaccuacgauuauccuaaauacucugaagaggcuaagcucaacagagaagagaucgacgggguuaaacuggaguccacacggauuuaucaaauccuugccauuuacagcacgguggcguccucucugguccucgugguuagccugggcgcuaucuccuuuuggaugugcucuaauggaagccugcagugccgcauuuguaucuga

SEQ ID NO: 190479 - RNA, 1701 nt, Artificial Sequence
  derived and/or modified sequence opt5 from hemagglutinin__InfluenzaA__AEO01366
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcagcacaaccugucaaaccccuaaaggcgccaucaauacaucucuccccuuccagaacgugcacccgauuacgaucggcaagugcccuaaguauguuaaaagcaccaagcugagacuugcuacagggcugcggaaugugcccuccauucagucucgcggacucuuuggcgccaucgccggguucauugagggaggcuggaccgggauggucgacggaugguacggcuaucaucaccagaacgaacaaggcagcggguacgcugcggaucugaaauccacacagaaugccaucgacgagaucaccaacaaggugaauagcguuauugagaaaaugaacacgcaguuuacagcugugggaaaggaguucaaucaccuugagaagagaaucgaaaaccugaauaaaaaggucgaugacggcuuccucgauauuuggaccuacaacgccgagcugcuggugcuccuggaaaaugagcggacccuugacuaucaugauucuaacgucaaaaaucuguacgagaaggugcgcucccagcucaaaaacaacgccaaggaaaucgggaauggauguuuugaguucuaucacaagugcgacaacacauguauggaaagcguuaaaaauggcaccuacgauuauccuaaguacucugaggaagcuaaacugaacagagaggagauugacggggugaaacuugaauccacacggaucuaucaaauccuggccauuuacagcacggucgcguccucucucgugcugguugugagccugggcgcuaucuccuuuuggaugugcucuaauggaagccuccagugccgcauuuguaucuga

SEQ ID NO: 190480 - RNA, 1701 nt, Artificial Sequence; identical to SEQ ID NO: 190451
  derived and/or modified sequence opt5 from hemagglutinin__InfluenzaA__AEO01367

SEQ ID NO: 190481 - RNA, 1701 nt, Artificial Sequence
  derived and/or modified sequence opt5 from hemagglutinin__InfluenzaA__AEO01368
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaauaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacaaaauuaccaacaaggucaauuccgugaucgagaaaaugaacacgcaguuuacagcuguuggaaaggaguucaaucaccuugaaaagagaauugagaaccugaauaaaaagguggaugacggcuuccucgauaucuggaccuacaacgccgaacugcugguccuccuggagaaugaacggacccuugacuaucaugauagcaacgugaaaaaccuguacgagaagguccgcucucagcucaaaaauaacgccaaggagauugggaauggauguuuugaguucuaucacaagugcgacaacacauguauggaguccgugaaaaauggcaccuacgauuauccuaaguacagcgaagaggcuaaacugaacagagaagagaucgacgggguuaagcuggagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190482 - RNA, 1701 nt, Artificial Sequence; identical to SEQ ID NO: 185693
  derived and/or modified sequence opt5 from hemagglutinin__InfluenzaA__AEO01369

SEQ ID NO: 190483 - RNA, 1701 nt, Artificial Sequence; identical to SEQ ID NO: 190411
  derived and/or modified sequence opt5 from hemagglutinin__InfluenzaA__AEO01370

SEQ ID NO: 190484 - RNA, 1701 nt, Artificial Sequence; identical to SEQ ID NO: 190458
  derived and/or modified sequence opt5 from hemagglutinin__InfluenzaA__AEO01371

SEQ ID NO: 190485 - RNA, 1701 nt, Artificial Sequence; identical to SEQ ID NO: 187290
  derived and/or modified sequence opt5 from hemagglutinin__InfluenzaA__AEO01372

SEQ ID NO: 190486 - RNA, 1701 nt, Artificial Sequence; identical to SEQ ID NO: 187290
  derived and/or modified sequence opt5 from hemagglutinin__InfluenzaA__AEO01373

SEQ ID NO: 190487 - RNA, 1701 nt, Artificial Sequence
  derived and/or modified sequence opt5 from hemagglutinin__InfluenzaA__AEO01374
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguauaucaaaucuaccaagcugagacuugcuacagggcugcggaaugugcccagcauucagucccgcggacucuuuggcgccaucgccggguucaucgagggaggcuggaccgggaugguugauggaugguacggcuaucaucaccagaacgaacaaggcucuggguacgcugcggaccugaaaagcacacagcacgccauugaugagaucaccaauaaggugaacuccgucauugagaaaaugaauacgcaguuuacagcugugggaaaggaguucaaccaucuugagaagagaaucgaaaaucugaacaaaaagguugacgauggcuuccucgacauuuggaccuacaaugccgagcugcuggugcuccuggaaaacgagcggacccuugauuaucacgacagcaaugucaaaaaccuguacgagaaggugcgcucucagcucaaaaauaacgccaaggaaaucgggaacggauguuuugaguucuaucauaagugcgauaauacauguauggaauccgucaaaaacggcaccuacgacuauccuaaguacagcgaggaagcuaaacugaauagagaggagaucgauggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190488 - RNA, 1701 nt, Artificial Sequence; identical to SEQ ID NO: 190462
  derived and/or modified sequence opt5 from hemagglutinin__InfluenzaA__AEO01375

SEQ ID NO: 190489 - RNA, 1701 nt, Artificial Sequence; identical to SEQ ID NO: 185693
  derived and/or modified sequence opt5 from hemagglutinin__InfluenzaA__AEO01376

SEQ ID NO: 190490 - RNA, 1701 nt, Artificial Sequence; identical to SEQ ID NO: 187861
  derived and/or modified sequence opt5 from hemagglutinin__InfluenzaA__AEO01377

SEQ ID NO: 190491 - RNA, 1701 nt, Artificial Sequence
  derived and/or modified sequence opt5 from hemagglutinin__InfluenzaA__AEO01378
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190492 - RNA, 1701 nt, Artificial Sequence; identical to SEQ ID NO: 186857
  derived and/or modified sequence opt5 from hemagglutinin__InfluenzaA__AEO01379

SEQ ID NO: 190493 - RNA, 1701 nt, Artificial Sequence; identical to SEQ ID NO: 190462
  derived and/or modified sequence opt5 from hemagglutinin__InfluenzaA__AEO01380

SEQ ID NO: 190494 - RNA, 1701 nt, Artificial Sequence; identical to SEQ ID NO: 190462
  derived and/or modified sequence opt5 from hemagglutinin__InfluenzaA__AEO01381

SEQ ID NO: 190495 - RNA, 1701 nt, Artificial Sequence; identical to SEQ ID NO: 186857
  derived and/or modified sequence opt5 from hemagglutinin__InfluenzaA__AEO01382

SEQ ID NO: 190496 - RNA, 1701 nt, Artificial Sequence; identical to SEQ ID NO: 187290
  derived and/or modified sequence opt5 from hemagglutinin__InfluenzaA__AEO01383

SEQ ID NO: 190497 - RNA, 1701 nt, Artificial Sequence
  derived and/or modified sequence opt5 from hemagglutinin__InfluenzaA__AEO01384
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguuucuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 190498 - RNA, 1701 nt, Artificial Sequence
  derived and/or modified sequence opt5 from hemagglutinin__InfluenzaA__AEO01385
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcuaaugccuacguguucgugggaacauccagauauagcaagaaauuuaagccugagaucgcuauucggccgaaaguccgcgaccaggaggggagaaugaacuacuauuggacccucguugaacccggagauaagaucacguucgaggccacaggcaaccugguggugccucgguacgcguuugccauggaacgcaaugcugggucuggaauuaucaucuccgacacccccguccaugauugcaacacaaccugucaaaccccuaaaggcgccauuaauacaagccugcccuuccagaacauccacccgauuacgaucggcaagugcccuaaguaugugaaaucuaccaagcucagacuggcuacagggcuucggaauguucccagcauucagucccgcggacuguuuggcgccaucgccggguucaucgagggaggcuggaccgggaugguggacggaugguacggcuaucaucaccagaacgaacaaggcucuggguacgcugcggaccucaaaagcacacagaaugccauugaugagaucaccaacaaggucaauuccgugauugagaaaaugaacacgcaguuuacagcuguuggaaaggaguucaaucaccuggagaagagaaucgaaaaccuuaauaaaaagguggacgauggcuuccuggacauuuggaccuacaacgccgagcuccugguccugcucgaaaaugagcggacccuggauuaucaugacagcaacgugaaaaaccuuuacgagaagguccgcucucagcugaaaaauaacgccaaggaaaucgggaauggauguuuugaguucuaucacaagugcgauaacacauguauggaauccgugaaaaauggcaccuacgacuauccuaaguacagcgaggaagcuaaacucaacagagaggagaucgaugggguuaagcuggaaucuacacggauuuaucaaauccuugccauuuacuccacgguggcgagcucccugguccucgugguuucucugggcgcuaucagcuuuuggaugugcuccaauggaucucugcagugccgcauuuguaucuga

SEQ ID NO: 190499 - RNA, 1701 nt, Artificial Sequence; identical to SEQ ID NO: 190402
  derived and/or modified sequence opt5 from hemagglutinin__InfluenzaA__AEO01386

SEQ ID NO: 190500 - RNA, 1701 nt, Artificial Sequence
  derived and/or modified sequence opt5 from hemagglutinin__InfluenzaA__AEO01387
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauauccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauaccuguauggaauccgugaaaaacggcacauacgauuauccuaaguacagcgaggaagcuaaacucaauagagaggagauugacgggguuaagcuggaaucuacccggaucuaucaaauucuugccaucuacuccacaguggcgagcucccugguccucgugguuucucugggcgcuauuagcuuuuggaugugcuccaacggaucucugcagugccgcaucuguauuuga

SEQ ID NO: 190501 - RNA, 1701 nt, Artificial Sequence
  derived and/or modified sequence opt5 from hemagglutinin__InfluenzaA__AEO01388
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagacaaacgccaaagagauugggaauggauguuuugaguucuaucacaagugcgacaacaccuguauggaguccgugaaaaauggcacauacgauuauccuaaguacagcgaagaggcuaaacugaaccgcgaagagaucgacgggguuaagcuggagucuacgagaaucuaucaaauucuggccaucuacuccaccguggcgagcucccucguccuggugguuucucugggcgcuauuagcuuuuggaugugcuccaauggaucucuccagugccggaucuguauuuga

SEQ ID NO: 190502 - RNA, 1701 nt, Artificial Sequence
  derived and/or modified sequence opt5 from hemagglutinin__InfluenzaA__AEO01389
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcaccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaguggaugacggcuuccucgauaucuggaccuacaaugcugaacugcugguccuccuggagaacgaacggacacuugacuaucaugauagcaaugugaagaaccuguacgagaaaguccgcucucagcucaagaacaaugccaaggagauugggaacggauguuuugaguucuaucacaaaugcgacaauaccuguauggaauccgugaagaacggcacauacgauuauccuaaauacagcgaagaggccaagcugaauagagaagagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 190503 - RNA, 1701 nt, Artificial Sequence
  derived and/or modified sequence opt5 from hemagglutinin__InfluenzaA__AEO01390
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaggaacugcgggagcagcuuuccagcgucucuuccuucgaacgcuuugagaucuuccccaagacgagcucuuggccuaaucacgauuccaacaagggagugaccgccgcuuguccccaugccggcgcgaaauccuuuuauaagaaucugauuuggcucguuaaaaagggcaacucuuacccuaaacuguccaagagcuauaucaaugacaaggggaaagaagugcuuguccuguggggcauucaccaccccuccacaucugccgaucaacagagccucuaccagaacgcugacgccuacguguucguggagaccuccagauauagcaagaaagucaagccugagaucgcuauucggccgcgcguuagagaucaggaaggccggaugaauuacuauuggacacugguggagcccggggacaaaaucaccuuugaagccacgggaaaccugguggucccucgcuacgcguucgccauggagagaaacgcuggcucugggauuaucaucuccgauacacccgugcaugacugcaauaccacaugucaaaccccuaagggagccauuaacaccagccuccccuuucagaauauccacccgauuacaaucggcaaaugcccuaaguauguuaagucuacgaaacugcggcuugcuaccggccugcgcaacgugcccagcauucaguccagagggcuguucggagccaucgccggcuuuaucgaagggggauggacaggcauggucgacgggugguacggauaucaucaccagaaugagcaaggcucuggcuacgcugcggaucucaagagcacccagcacgccauugacgagaucacaaacaaagugaauagcguuauugaaaagaugaacacccaguucacggcuguggggaaagaguuuaaucaucuugaaaagcggaucgagaaccugaauaagaaagucgaugacggauuccucgauauuuggacauacaacgccgaacugcuggugcuccuggagaaugagcgcacccuugacuaucacgauagcaacgucaagaaucuguacgaaaaagugagaucucagcucaagaacaacgccaaagagaucggcaauggguguuucgaauuuuaucauaagugcgacaacaccuguauggaguccguuaagaauggaacauacgauuauccuaaauacagcgaaguggcuaagcugaaccgggaggagaucaauggcgucaaacuugaaucuacccgcauuuaucaaauccuggccauuuacuccacaguggcgagcucccucguucugguggucucucugggggcuaucagcuucuggaugugcuccaacggcucucuccagugcagaauuuguaucuga

SEQ ID NO: 190504 - RNA, 1701 nt, Artificial Sequence; identical to SEQ ID NO: 190402
  derived and/or modified sequence opt5 from hemagglutinin__InfluenzaA__AEO01391

SEQ ID NO: 190505 - RNA, 1701 nt, Artificial Sequence; identical to SEQ ID NO: 190411
  derived and/or modified sequence opt5 from hemagglutinin__InfluenzaA__AEO01392

SEQ ID NO: 190506 - RNA, 1701 nt, Artificial Sequence; identical to SEQ ID NO: 187290
  derived and/or modified sequence opt5 from hemagglutinin__InfluenzaA__AEO01393

SEQ ID NO: 190507 - RNA, 1701 nt, Artificial Sequence; identical to SEQ ID NO: 186794
  derived and/or modified sequence opt5 from hemagglutinin__InfluenzaA__AEO01394

SEQ ID NO: 190508 - RNA, 1701 nt, Artificial Sequence
  derived and/or modified sequence opt5 from hemagglutinin__InfluenzaA__AEO01395
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuucuggacuacgaagaacuucgggagcagcuguccagcgucucuuccuucgaacgcuuugagauuuuccccaagaccagcucuuggccuaaucacgauuccaacaagggagugacagccgcuuguccccaugccggcgcgaaaucuuuuuauaagaaucucaucuggcugguuaaaaagggcaacagcuacccuaaacuuuccaagagcuauaucaaugacaaggggaaagaagugcugguccucuggggcauucaccaccccuccaccucugccgaucaacagagccuguaccagaacgcugacgccuacguguucgugggaacauccagauauagcaagaaauuuaagccugagaucgcuauucggccgaaaguccgcgagcaggaagggagaaugaauuacuauuggacccugguugagcccggagauaagaucacguucgaagccacaggcaaccucguggugccucgguacgcguuugccauggagcgcaacgcugggucuggaauuaucauuuccgacacccccguccaugauugcaauacaaccugucaaaccccuaaaggcgccaucaacacaagccugcccuuccagaauauccacccgauuacgaucggcaagugcccuaaguaugugaaaucuaccaaacuuagacuggcuacagggcuccggaacguucccagcauucagucccgcggacuguuuggcgccaucgccggguucauugaaggaggcuggaccgggaugguggacggaugguacggcuaucaucaccagaaugagcaaggcucuggguacgcugcggaccuuaaaagcacacagaacgccaucgaugagaucaccaauaaggucaacuccgugauugaaaagaugaauacgcaguuuacagcuguuggaaaggaguucaaccaccuggaaaagagaaucgagaaucucaacaaaaagguggacgauggcuuccuggacauuuggaccuacaaugccgaacugcucguccugcuugagaacgagcggacccuggauuaucaugacagcaaugugaaaaaccucuacgaaaagguccgcucucagcugaaaaacaaugccaaggagaucgggaacggauguuuugaguucuaucacaagugcgauaauacauguauggaguccgugaaaaacggcaccuacgacuauccuaaguacagcgaagaggcuaaacuuaauagagaggaaauugaugggguuaagcuggagucuacacggaucuaucaaauccucgccauuuacuccacgguggcgagcucccugguccuggugguuucucucggcgcuaucagcuuuuggaugugcuccaacggaucucugcagugccgcauuuguaucuga

SEQ ID NO: 190509 - RNA, 1701 nt, Artificial Sequence; identical to SEQ ID NO: 186794
  derived and/or modified sequence opt5 from hemagglutinin__InfluenzaA__AEO01396

SEQ ID NO: 190510 - RNA, 1701 nt, Artificial Sequence
  derived and/or modified sequence opt5 from hemagglutinin__InfluenzaA__AEO01397
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacacagacgcuuacguguucgugggaaccuccagauauagcaagaaauuuaagccugagaucgccauucggccgaaaguccgcgaucaggaggggagaaugaauuacuauuggacgcucguugaacccggagacaagaucacauucgaggcuaccggcaaccugguggugccucgguacgccuuugcgauggaacgcaacgccgggucuggaauuaucaucuccgauacacccguccaugacugcaauaccaccugucaaacaccuaaaggcgcuauuaacacgagccugcccuuccagaauauccacccgauuaccaucggcaagugcccuaaguaugugaaaucuacaaagcucagacuggccaccgggcuucggaacguucccagcauucagucccgcggacuguuuggcgcuaucgccggguucaucgagggaggcuggacagggaugguggacggaugguacggcuaucaucaccagaaugaacaaggcucuggguacgccgcugaucucaaaagcacccagaacgcgauugacgagaucacgaauaaggucaacuccgugauugagaaaaugaauacacaguuuaccgccguuggaaaggaguucaaccaccuggagaagagaaucgaaaaucuuaacaaaaagguggaugacggcuuccuggauauuuggaccuacaaugcugagcuccugguccugcucgaaaacgagcggacacuggacuaucaugauagcaaugugaaaaaccuuuacgagaagguccgcucucagcugaaaaacaaugccaaggaaaucgggaacggauguuuugaguucuaucacaagugcgacaauaccuguauggaauccgugaaaaacggcacauacgauuauccuaaguacagcgaggaagccaaacucaauagagaggagaucgacgggguuaagcuggaaucuacgcggauuuaucaaauccuugcuauuuacuccaccguggccagcucccugguccucgugguuucucugggcgcgaucagcuuuuggaugugcuccaacggaucucugcagugccgcauuuguaucuga

SEQ ID NO: 190511 - RNA, 1701 nt, Artificial Sequence
  derived and/or modified sequence opt5 from hemagglutinin__InfluenzaA__AEO01398
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccaauguguucgugggcacauccagauacagcaagaaauuuaagccugagauugcuauccggccgaaaguccgcgggcaggagggaagaaugaacuauuacuggacccugguugaacccggcgauaagauuacguucgaggccacagggaaccugguggugccucgguaugcguuugccauggaacgcaaugcuggaucuggcaucauuaucuccgacacccccguccaugauugcaacacaaccugucaaaccccuaaaggcgccaucaauacaagccuccccuuccagaacauucacccgaucacgauugggaagugcccuaaguacgugaaaucuaccaagcugagacuugcuacaggacugcggaauguucccagcauccagucccgcggccucuuuggggccauugccggauucaucgagggcggguggaccggaaugguggacggcugguauggcuaccaucaccagaacgaacaagggucuggauaugcugcggaccugaaaagcacacagaaugccaucgaugagauuaccaacaaggucaauuccgugaucgagaaaaugaacacgcaguuuacagcuguuggcaaggaguucaaucaccuugagaagagaauugaaaaccugaauaaaaagguggacgauggguuccucgacaucuggaccuacaacgccgagcugcugguccuccuggaaaaugagcggacccuugauuaccaugacagcaacgugaaaaaccuguaugagaagguccgcaaucagcucaaaaacaaugccaaggaaauuggaaacggcuguuuugaguucuaccacaagugcgauaauacauguauggaaucugugaaaaacgggaccuaugacuacccuaaguauuccgaggaagcuaaacugaauagagaggagaucgauggcguuaaacuugaaagcacacggaucuaccaaauucuggccaucuauucuacgguggcguccagccucguccuggugguuucccugggagcuauuucuuuuuggaugugcagcaacggcucccuccagugccgcaucuguauuuga

SEQ ID NO: 190512 - RNA, 1701 nt, Artificial Sequence; identical to SEQ ID NO: 190411
  derived and/or modified sequence opt5 from hemagglutinin__InfluenzaA__AEO01399

SEQ ID NO: 190513 - RNA, 1701 nt, Artificial Sequence; identical to SEQ ID NO: 185693
  derived and/or modified sequence opt5 from hemagglutinin__InfluenzaA__AEO01402

SEQ ID NO: 190514 - RNA, 1701 nt, Artificial Sequence; identical to SEQ ID NO: 186857
  derived and/or modified sequence opt5 from hemagglutinin__InfluenzaA__AEO01403

SEQ ID NO: 190515 - RNA, 1701 nt, Artificial Sequence; identical to SEQ ID NO: 185693
  derived and/or modified sequence opt5 from hemagglutinin__InfluenzaA__AEO01404

SEQ ID NO: 190516 - RNA, 1701 nt, Artificial Sequence
  derived and/or modified sequence opt5 from hemagglutinin__InfluenzaA__AEO01405
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacaaugaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 190517 - RNA, 1701 nt, Artificial Sequence
  derived and/or modified sequence opt5 from hemagglutinin__InfluenzaA__AEO01407
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagcacgccaucgacgagauuaccaacaaggucaauuccgugaucgagaaaaugaacacgcaguuuacagcuguuggaaaggaguucaaucaucuugagaagagaauugaaaaccugaauaaaaagguggaugacggcuuccucgauaucuggaccuacaacgccgagcugcugguccuccuggaaaaugagcggacccuugacuaucacgauagcaacgugaaaaaucuguacgagaagguccgcucucagcucaaaaacaacgccaaggaaauugggaauggauguuuugaguucuaucauaagugcgacaacacauguauggaauccgugaaaaauggcaccuacgauuauccuaaguacagcgaggaagcuaaacugaacagagaggagaucaaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190518 - RNA, 1701 nt, Artificial Sequence
  derived and/or modified sequence opt5 from hemagglutinin__InfluenzaA__AEO01408
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagaucgacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccgucaaaaacggcaccuacgacuauccuaaguacagcgaagaggcuaaacugaauagagaggaaaucgauggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190519 - RNA, 1701 nt, Artificial Sequence; identical to SEQ ID NO: 186795
  derived and/or modified sequence opt5 from hemagglutinin__InfluenzaA__AEO01409

SEQ ID NO: 190520 - RNA, 1701 nt, Artificial Sequence; identical to SEQ ID NO: 190411
  derived and/or modified sequence opt5 from hemagglutinin__InfluenzaA__AEO01410

SEQ ID NO: 190521 - RNA, 1701 nt, Artificial Sequence; identical to SEQ ID NO: 189112
  derived and/or modified sequence opt5 from hemagglutinin__InfluenzaA__AEO01411

SEQ ID NO: 190522 - RNA, 1701 nt, Artificial Sequence; identical to SEQ ID NO: 186046
  derived and/or modified sequence opt5 from hemagglutinin__InfluenzaA__AEO01412

SEQ ID NO: 190523 - RNA, 1701 nt, Artificial Sequence
  derived and/or modified sequence opt5 from hemagglutinin__InfluenzaA__AEO01413
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaaguccaacgccaaggagauugggaauggauguuuugaguucuaucacaaaugcgacaacacauguauggaaagcgugaagaauggcaccuacgauuauccuaaauacucugaagaggcuaagcugaacagagaagagaucgacgggguuaaacuugaguccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 190524 - RNA, 1701 nt, Artificial Sequence
  derived and/or modified sequence opt5 from hemagglutinin__InfluenzaA__AEO01414
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacaccgggucuggaaucauuaucuccgauacacccguccaugacugcagcaccaccugucaaacaccuaaaggcgcuaucaauacgucucuccccuuccagaacgugcacccgauuaccaucggcaagugcccuaaguauguuaaaagcacaaagcugagacuugccaccgggcugcggaaugugcccuccauucagucucgcggacucuuuggcgcuaucgccggguucauugagggaggcuggacagggauggucgacggaugguacggcuaucaucaccagaacgaacaaggcagcggguacgccgcugaucugaaauccacccagaaugcgaucgacgagaucacgaacaaggugaauagcguuauugagaaaaugaacacacaguuuaccgccgugggaaaggaguucaaucaccuugagaagagaaucgaaaaccugaauaaaaaggucgaugacggcuuccucgauauuuggaccuacaacgcugagcugcuggugcuccuggaaaaugagcggacacuugacuaucaugauucuaacgucaaaaaucuguacgagaaggugcgcucccagcucaaaaacaacgccaaggaaaucgggaauggauguuuugaguucuaucacaagugcgacaacaccuguauggaaagcguuaaaaauggcacauacgauuauccuaaguacucugaggaagccaaacugaacagagaggagauugacggggugaaacuugaauccacgcggaucuaucaaauccuggcuauuuacagcaccgucgccuccucucucgugcugguugugagccugggcgcgaucuccuuuuggaugugcucuaauggaagccuccagugccgcauuuguaucuga

SEQ ID NO: 190525 - RNA, 1701 nt, Artificial Sequence; identical to SEQ ID NO: 189324
  derived and/or modified sequence opt5 from hemagglutinin__InfluenzaA__AEO01416

SEQ ID NO: 190526 - RNA, 1701 nt, Artificial Sequence; identical to SEQ ID NO: 186857
  derived and/or modified sequence opt5 from hemagglutinin__InfluenzaA__AEO01418

SEQ ID NO: 190527 - RNA, 1701 nt, Artificial Sequence; identical to SEQ ID NO: 186857
  derived and/or modified sequence opt5 from hemagglutinin__InfluenzaA__AEO01419

SEQ ID NO: 190528 - RNA, 1701 nt, Artificial Sequence
  derived and/or modified sequence opt5 from hemagglutinin__InfluenzaA__AEO01420
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaauacaagcacaaugggaaacuuuguaagcugagaggaguugcuccccuccaucugggcaaaugcaacaucgccggguggauucugggaaauccugagugugaaucucucagcacagccuccucuuggagcuauaucguggagaccuccaacucugauaauggcacgugcuacccgggggacuuuauugauuaugaagaacugcgggagcagcuuagcuccgucagcucuuucgaacgcuuugagaucuuccccaagaccuccagcuggccuaaccacgacucuaauaagggagugacagccgcuuguccccaugccggcgcgaaauccuuuuacaagaaccugaucuggcucguuaaaaagggcaauagcuauccuaaacugucuaaguccuacauuaacgauaaggggaaagaagugcuuguccuguggggaauccaccaccccagcaccuccgccgaccaacagucucucuaccagaaugcugaugccuauguguucgugggcacaagcagauacuccaagaaauuuaagccugagauugcuauccggccgaaaguccgcgaccaggaggggagaaugaacuauuacuggacccugguugaacccggagauaagauuacguucgaggccacaggcaaccugguggugccucgguaugcguuugccauggaacgcaaugcugggagcggaaucauuaucucugacacccccguccaugauugcaacacaaccugucaaaccccuaaaggcgccaucaauacaucccuccccuuccagaacauucacccgaucacgauuggcaagugcccuaaguacgugaaaagcaccaagcugagacuugcuacagggcugcggaauguucccucuauccagagccgcggacucuuuggcgccauugccggguucaucgagggaggcuggaccgggaugguggacggaugguauggcuaccaucaccagaacgaacaaggcuccggguacgcugcggaccugaaaucuacacagaaugccaucgaugagauuaccaacaaggucaauagcgugaucgagaaaaugaacacgcaguuuacagcuguuggaaaggaguucaaucaccuugagaagagaauugaaaaccugaauaaaaagguggacgauggcuuccucgacaucuggaccuauaacgccgagcugcugguccuccuggaaaaugagcggacccuugauuaccaugacuccaacgugaaaaaccuguaugagaagguccgcagccagcucaaaaauaacgccaaggaaauugggaauggauguuuugaguucuaccacaagugcgauaacacauguauggaaucugugaaaaauggcaccuaugacuacccuaaguauuccgaggaagcuaaacugaacagagaggagaucgaugggguuaaacuugaaagcacacggaucuaccaaauucuggccaucuacucuacgguggcguccagccucguccuggugguuucccugggcgcuauuucuuuuuggaugugcagcaauggaucccuccagugccgcaucuguauuuga

SEQ ID NO: 190529 - RNA, 1701 nt, Artificial Sequence
  derived and/or modified sequence opt5 from hemagglutinin__InfluenzaA__AEO01421
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagaacaaugccaaagagauugggaacggauguuuugaguucuaucacaagugcgacaauacauguauggaguccgugaaaaacggcaccuacgauuauccuaaguacagcgaagaggcuaaacugaaucgcgaagagaucgacgggguuaagcuggagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 190530 - RNA, 1701 nt, Artificial Sequence
  derived and/or modified sequence opt5 from hemagglutinin__InfluenzaA__AEO01422
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaaccuguacccuaaacuuagcaaguccuauaucaaugacaaggggaaagaagugcugguccucuggggcauucaccaccccagcacauccgccgaucaacagucucuguaccagaacgcugacgccuacguguucgugggcaccagcagauauuccaagaaauuuaagccugagaucgcuauucggccgaaaguccgcgaucaggaggggagaaugaauuacuauuggacacugguugaacccggagacaagaucaccuucgaggccacgggcaaccucguggugccucgguacgcguuugccauggaacgcaacgcugggagcggaauuaucaucucugauacacccguccaugacugcaauaccacaugucaaaccccuaaaggcgccauuaacaccucccugcccuuccagaauauccacccgauuacaaucggcaagugcccuaaguaugugaaaagcacgaaacuuagacuggcuaccgggcuccggaacguucccucuauucagagccgcggacuguuuggcgccaucgccggguucaucgagggaggcuggacagggaugguggacggaugguacggcuaucaucaccagaaugaacaaggcuccggguacgcugcggaucuuaagucuacccagcacgccauugacgagaucacaaacaaggucaauagcgugauugagaaaaugaacacccaguuuacggcuguuggaaaggaguucaaucaucuggagaagagaaucgaaaaccucaauaaaaagguggaugacggcuuccuggauauuuggacauacaacgccgagcugcucguccugcuugaaaaugagcggacccuggacuaucacgauuccaacgugaaaaaucucuacgagaagguccgcagccagcugaaaaacaacgccaaggaaaucgggaauggauguuuugaguucuaucauaagugcgacaacaccuguauggaaucugugaaaaauggcacauacgauuauccuaaguacuccgaggaagcuaaacuuaacagagaggagaucaaugggguuaagcuggaaagcacccggauuuaucaaauccucgccauuuacucuacaguggcguccagccugguccuggugguuucccucggcgcuaucucuuuuuggaugugcagcaacggaucccugcagugccgcauuuguaucuga

SEQ ID NO: 190531 - RNA, 1701 nt, Artificial Sequence
  derived and/or modified sequence opt5 from hemagglutinin__InfluenzaA__AEO01423
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucaccauucggccgaaagugcgcgaucaggaggggagaaugaauuacuauuggacgcuggucgaacccggagacaagaucacauucgaggcuaccggcaaccugguugugccucgguacgccuuugcgauggaacgcaacgccgggucuggaauuaucaucuccgauacacccgugcaugacugcaauaccaccugucaaacaccuaaaggcgcuauuaacacgagccuccccuuccagaauauccacccgauuaccaucggcaagugcccuaaguaugucaaaucuacaaagcugagacuugccaccgggcugcggaacgugcccagcauucagucccgcggacucuuuggcgcuaucgccggguucaucgagggaggcuggacagggaugguugacggaugguacggcuaucaucaccagaaugaacaaggcucuggguacgccgcugaucugaaaagcacccagaacgcgauugacgagaucacgaauaaggugaacuccgucauugagaaaaugaauacacaguuuaccgccgugggaaaggaguucaaccaccuugagaagagaaucgaaaaucugaacaaaaagguugaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 190532 - RNA, 1701 nt, Artificial Sequence; identical to SEQ ID NO: 190529
  derived and/or modified sequence opt5 from hemagglutinin__InfluenzaA__AEO01424

SEQ ID NO: 190533 - RNA, 1701 nt, Artificial Sequence; identical to SEQ ID NO: 190529
  derived and/or modified sequence opt5 from hemagglutinin__InfluenzaA__AEO01425

SEQ ID NO: 190534 - RNA, 1701 nt, Artificial Sequence; identical to SEQ ID NO: 185693
  derived and/or modified sequence opt5 from hemagglutinin__InfluenzaA__AEO01426

SEQ ID NO: 190535 - RNA, 1701 nt, Artificial Sequence
  derived and/or modified sequence opt5 from hemagglutinin__InfluenzaA__AEO01427
augaaggccauccuggugguccuccuguacaccuucgcuacagccaacagcgacacgcuuugcauuggcuaucacgcgaauaacuccaccgauacaguugacaccgugcuggagaaaaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacaagauuaccaauaaagucaacagcgugaucgagaagaugaauacgcaguuuacagccguuggaaaggaguucaaccaccuugagaaaagaauugagaaucugaacaagaaaguggaugacggcuuccucgauaucuggaccuacaaugcugaacugcugguccuccuggagaacgaacggacccuugacuaucaugauucuaaugugaagaaccuguacgagaaaguccgcucccagcucaagaacaaugccaaggagauugggaacggauguuuugaguucuaucacaaaugcgacaauacauguauggaaagcgugaagaacggcaccuacgauuauccuaaauacucugaagaggccaagcugaauagagaagagaucgacgggguuaaacuugaguccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 190536 - RNA, 1701 nt, Artificial Sequence
  derived and/or modified sequence opt5 from hemagglutinin__InfluenzaA__AEO01428
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccugaucacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagaauggcuacagggcuucggaauguucccagcauccagucccgcggacuguuuggcgccauugccggguucaucgagggaggcuggaccgggaugguggauggaugguacggcuaucaucaccagaacgaacaaggcucuggguacgcugcggaccucaaaagcacacagaaugccaucgaugagauuaccaacaaggucaauuccgugaucgagaaaaugaacacgcaguuuacagcuguuggaaaggaguucaaucaccuggagaagagaauugaaaaccuuaauaaaaagguggacgauggcuuccuggacaucuggaccuacaacgccgagcuccugguccugcucgaaaaugagcggacccuggauuaucaugacagcaacgugaaaaaucuuuacgagaagguccgcucucagcugaaaaacaacgccaaggaaauugggaauggauguuuugaguucuaucacaagugcgauaacacauguauggaauccgugaaaaauggcaccuacgacuauccuaaguacagcgaggaagcuaaacucaacagagaggagaucgaugggguuaagcuggaaucuacacggaucuaucaaauucuugccaucuacuccacgguggcgagcucccugguccucgugguuucucugggcgcuauuagcuuuuggaugugcuccaauggaucucugcagugccgcaucuguauuuga

SEQ ID NO: 190537 - RNA, 1701 nt, Artificial Sequence; identical to SEQ ID NO: 186857
  derived and/or modified sequence opt5 from hemagglutinin__InfluenzaA__AEO01429

SEQ ID NO: 190538 - RNA, 1701 nt, Artificial Sequence
  derived and/or modified sequence opt5 from hemagglutinin__InfluenzaA__AEO01430
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugacggcgccaagagcuuuuauaagaaucugaucuggcucguuaaaaagggcaacucuuacccuaaacuguccaagagcuauauuaaugauaaggggaaagaagugcuuguccuguggggaauccaccaccccuccaccucugcggaccaacagagccucuaccagaacgccgaugcuuacguguucgugggcacauccagauauagcaagaaauuuaagccugagauugccauccggccgaaaguccgcgaccaggaggggagaaugaauuacuauuggacccugguugaacccggagauaagauuacguucgaggcuacaggcaaccugguggugccucgguacgccuuugcgauggaacgcaacgccgggucuggaaucauuaucuccgacacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgagggaggcuggaccgggaugguggauggaugguacggcuaucaucaccagaaugaacaaggcucuggguacgccgcugaccugaaaagcacacagaacgcgaucgaugagauuaccaauaaggucaacuccgugaucgagaaaaugaauacgcaguuuacagccguuggaaaggaguucaaccaccuugagaagagaauugaaaaucugaacaaaaagguggacgauggcuuccucgacaucuggaccuacaaugcugagcugcugguccuccuggaaaacgagcggacccuugauuaucaugacagcaaugugaaaaaccuguacgagaagguccgcucucagcucaaaaacaaugccaaggaaauugggaacggauguuuugaguucuaucacaagugcgauaauacauguauggaauccgugaaaaacggcaccuacgacuauccuaaguacagcgaggaagccaaacugaauagagaggagaucgaugggguuaaacuugaaucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 190539 - RNA, 1701 nt, Artificial Sequence; identical to SEQ ID NO: 190411
  derived and/or modified sequence opt5 from hemagglutinin__InfluenzaA__AEO01431

SEQ ID NO: 190540 - RNA, 1701 nt, Artificial Sequence; identical to SEQ ID NO: 185693
  derived and/or modified sequence opt5 from hemagglutinin__InfluenzaA__AEO01432

SEQ ID NO: 190541 - RNA, 1701 nt, Artificial Sequence
  derived and/or modified sequence opt5 from hemagglutinin__InfluenzaA__AEO01434
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcgagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcugaauaaauccuauauuaacgacaaggggaaggaggugcuuguccuguggggaauccaccaccccagcaccuccgccgaucaacagucucucuaccagaaugcugacgccuacguguucgugggcacaagcagauauuccaaaaaguuuaaaccugagauugcuauccggccgaagguccgcgaucaggaagggagaaugaacuacuauuggacccugguugagcccggagacaaaauuacguucgaagccacaggcaaccugguggugccucgguacgcguuugccauggagcgcaaugcugggagcggaaucauuaucucugauacccccguccaugacugcaacacaaccugucaaaccccuaagggcgccaucaauacaucccuccccuuccagaacauucacccgaucacgauuggcgaaugcccuaaauauguuaagagcaccaagcugagacuugcuacagggcugcggaaugugcccucuauccagagccgcggacucuuuggcgccauugccggguucaucgagggaggcuggaccgggaugguggacggaugguacggcuaucaucaccagaacgagcaaggcuccggguacgcugcggaucugaaaucuacacagaaugccaucgacaagauuaccaacaaagucaauagcgugaucgaaaagaugaacacgcaguuuacagcuguuggaaaagaguucaaucaccuugaaaagagaauugagaaccugaauaagaaaguggaugacggcuuccucgauaucuggaccuacaacgccgaacugcugguccuccuggagaaugagcggacccuugacuaucaugauuccaacgugaagaaccuguacgaaaaaguccgcagccagcucaagaauaacgccaaagagauugggaauggauguuuugaguucuaucacaagugcgacaacacauguauggaaucugugaagaauggcaccuacgauuauccuaaauacuccgaagaggcuaagcugaacagagaggaaaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 190542 - RNA, 1701 nt, Artificial Sequence
  derived and/or modified sequence opt5 from hemagglutinin__InfluenzaA__AEO01435
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgucuaugacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaucagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuauaaugccgaacugcugguccuccuggagaacgaacggacccuugacuaccacgauagcaaugugaagaaccuguaugagaaaguccgcaaccagcucaagaauaacgccaaggagauugggaauggauguuuugaguucuaccauaaaugcgacaacacauguauggaaucugugaagaauggcaccuaugauuacccuaaauauuccgaagaggcuaagcugaacagagaagagaucgacgggguuaaacuugagagcacacggaucuaccaaauucuggccaucuacucuacgguggcguccagccucguccuggugguuucccugggcgcuauuucuuuuuggaugugcagcaauggaucccuccagugccgcaucuguauuuga

SEQ ID NO: 190543 - RNA, 1701 nt, Artificial Sequence; identical to SEQ ID NO: 190529
  derived and/or modified sequence opt5 from hemagglutinin__InfluenzaA__AEO01436

SEQ ID NO: 190544 - RNA, 1701 nt, Artificial Sequence; identical to SEQ ID NO: 190411
  derived and/or modified sequence opt5 from hemagglutinin__InfluenzaA__AEO01437

SEQ ID NO: 190545 - RNA, 1701 nt, Artificial Sequence; identical to SEQ ID NO: 190462
  derived and/or modified sequence opt5 from hemagglutinin__InfluenzaA__AEO01438

SEQ ID NO: 190546 - RNA, 1701 nt, Artificial Sequence; identical to SEQ ID NO: 186046
  derived and/or modified sequence opt5 from hemagglutinin__InfluenzaA__AEO01440

SEQ ID NO: 190547 - RNA, 1701 nt, Artificial Sequence
  derived and/or modified sequence opt5 from hemagglutinin__InfluenzaA__AEO01441
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgaugggucuggaaucauuaucuccgacacccccguccaugacugcaauacaaccugucaaaccccuaaaggcgcuaucaacacaagccuccccuuccagaauauucacccgaucacgauuggcaagugcccuaaguaugugaaaucuaccaagcugagacuugccacagggcugcggaacguucccagcauccagucccgcggacucuuuggcgcuauugccggguucaucgagggaggcuggaccgggaugguggauggaugguacggcuaucaucaccagaaugaacaaggcucuggguacgccgcugaccugaaaagcacacagaacgcgaucgauaagauuaccaauaaagucaacuccgugaucgagaagaugaauacgcaguuuacagccguuggaaaggaguucaaccaccuugagaaaagaauugagaaucugaacaagaaaguggacgauggcuuccucgacaucuggaccuacaaugcugaacugcugguccuccuggagaacgaacggacccuugauuaucaugacagcaaugugaagaaccuguacgagaaaguccgcucucagcucaagaacaaugccaaggagauugggaacggauguuuugaguucuaucacaaaugcgauaauacauguauggaauccgugaagaacggcaccuacgacuauccuaaauacagcgaagaggccaagcugaauagagaagagaucgaugggguuaaacuugagucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 190548 - RNA, 1701 nt, Artificial Sequence; identical to SEQ ID NO: 187113
  derived and/or modified sequence opt5 from hemagglutinin__InfluenzaA__AEO01442

SEQ ID NO: 190549 - RNA, 1701 nt, Artificial Sequence
  derived and/or modified sequence opt5 from hemagglutinin__InfluenzaA__AEO01443
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacaagauuaccaauaaagucaacuccgugaucgagaagaugaauacgcaguuuacagcuguugggaaggaguucaaccaccuugagaaaagaauugaaaaucugaacaagaaaguggaugacggauuccucgauaucuggaccuacaaugccgagcugcugguccuccuggaaaacgagcggacccuugacuaucaugauagcaaugugaagaaccuguacgagaaaguccgcucucagcucaagaacaaugccaaggaaauuggcaacggguguuuugaguucuaucacaaaugcgacaauacauguauggaauccgugaagaacggaaccuacgauuauccuaaauacagcgaggaagcuaagcugaauagagaggagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 190550 - RNA, 1701 nt, Artificial Sequence
  derived and/or modified sequence opt5 from hemagglutinin__InfluenzaA__AEO01444
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucugacaagggagugacagccgcuuguccccaugccggcgcgaaauccuuuuauaagaaucugaucuggcucguuaaaaagggcaacagcuacccuaaacugucuaaguccuauauuaaugauaaggggaaagaagugcuuguccuguggggaauccaccaccccagcaccuccgccgaccaacagucucucuaccagaacgcugaugccuacguguucgugggcacaagcagauauuccaagaaauuuaagccugagauugcuauccggccgaaaguccgcgaccaggaggggagaaugaauuacuauuggacccugguugaacccggagauaagauuacguucgaggccacaggcaaccugguggugccucgguacgcguuugccauggaacgcaacgcugggagcggaaucauuaucucugacacccccguccaugacugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgagggaggcuggaccgggaugguggauggaugguacggcuaucaucaccagaaugaacaaggcuccggguacgcugcggaccugaaaucuacacagaacgccaucgauaagauuaccaauaaagucaacagcgugaucgagaagaugaauacgcaguuuacagcuguuggaaaggaguucaaccaccuugagaaaagaauugagaaucugaacaagaaaguggacgauggcuuccucgacaucuggaccuacaaugccgaacugcugguccuccuggagaacgaacggacccuugauuaucaugacuccaaugugaagaaccuguacgagaaaguccgcagccagcucaagaacaaugccaaggagauugggaacggauguuuugaguucuaucacaaaugcgauaauacauguauggaaucugugaagaacggcaccuacgacuauccuaaauacuccgaagaggcuaagcugaauagagaagagaucgaugggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190551 - RNA, 1701 nt, Artificial Sequence; identical to SEQ ID NO: 187861
  derived and/or modified sequence opt5 from hemagglutinin__InfluenzaA__AEO01445

SEQ ID NO: 190552 - RNA, 1701 nt, Artificial Sequence; identical to SEQ ID NO: 190411
  derived and/or modified sequence opt5 from hemagglutinin__InfluenzaA__AEO01446

SEQ ID NO: 190553 - RNA, 1701 nt, Artificial Sequence
  derived and/or modified sequence opt5 from hemagglutinin__InfluenzaA__AEO01447
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgauugcgagcucccucgugcuggucgugucucugggcgcuaucagcuuuuggaugugcuccaacggaucucuccagugccgcauuuguaucuga

SEQ ID NO: 190554 - RNA, 1701 nt, Artificial Sequence; identical to SEQ ID NO: 186046
  derived and/or modified sequence opt5 from hemagglutinin__InfluenzaA__AEO01448

SEQ ID NO: 190555 - RNA, 1701 nt, Artificial Sequence; identical to SEQ ID NO: 190529
  derived and/or modified sequence opt5 from hemagglutinin__InfluenzaA__AEO01449

SEQ ID NO: 190556 - RNA, 1701 nt, Artificial Sequence
  derived and/or modified sequence opt5 from hemagglutinin__InfluenzaA__AEO01450
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucuacagaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagcacgcgaucgacgagauuacgaacaaggucaauuccgugaucgagaaaaugaacacacaguuuaccgccguuggaaaggaguucaaucaucuugagaagagaauugaaaaccugaauaaaaagguggaugacggcuuccucgauaucuggaccuacaacgcugagcugcugguccuccuggaaaaugagcggacacuugacuaucacgauagcaacgugaaaaaucuguacgagaagguccgcucucagcucaaaaacaacgccaaggaaauugggaauggauguuuugaguucuaucauaagugcgacaacaccuguauggaauccgugaaaaauggcacauacgauuauccuaaguacagcgaggaagccaaacugaacagagaggagaucgacgggguuaaacuugaaucuacgcggaucuaucaaauucuggcuaucuacuccaccguggccagcucccucguccuggugguuucucugggcgcgauuagcuuuuggaugugcuccaauggaucucuccagugccgcaucuguauuuga

SEQ ID NO: 190557 - RNA, 1701 nt, Artificial Sequence; identical to SEQ ID NO: 185693
  derived and/or modified sequence opt5 from hemagglutinin__InfluenzaA__AEO01451

SEQ ID NO: 190558 - RNA, 1701 nt, Artificial Sequence
  derived and/or modified sequence opt5 from hemagglutinin__InfluenzaA__AEO01452
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccgaagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccgcccaugacugcaauacaaccugucaaaccccuaaaggagcuaucaacacaagccuccccuuccagaauauucacccgaucacgauuggcaagugcccuaaguaugucaaaucuaccaagcugagacuugccacaggccugcggaacgugcccagcauccagucccgcgggcucuuuggagccauugcuggcuucaucgaagggggauggaccggcaugguugacgggugguacggauaucaucaccagaaugagcaaggcucuggcuacgcggccgaucugaaaagcacacagaacgcuaucgacgagauuaccaauaaggugaacuccgucaucgagaaaaugaauacgcaguuuacagccguggggaaggaguucaaccaccuugaaaagagaauugagaaucugaacaaaaagguugaugacggauuccucgauaucuggaccuacaaugccgaacugcuggugcuccuggagaacgagcggacccuugacuaucaugauagcaaugucaaaaagcuguacgaaaaagugcgcucucagcucaagaacaacgcuaaggagauuggcaauggguguuuugaguucuaucacaaaugcgacaacacauguauggaauccgucaagaauggaaccuacgauuauccuaaauacagcgaagaggccaagcugaacagagaggaaaucgacggcgugaaacuugagucuacacggaucuaucaaauucuggcgaucuacuccacgguugcuagcucccucgugcuggucgugucucugggggccauuagcuuuuggaugugcuccaauggcucucuccagugccgcaucuguauuuga

SEQ ID NO: 190559 - RNA, 1701 nt, Artificial Sequence
  derived and/or modified sequence opt5 from hemagglutinin__InfluenzaA__AEO01453
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacgggaccugcuauccgggcgauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaauccuuuuauaagaaucugauuuggcucguuaaaaagggcaacucuuacccuaaacuguccaagagcuauaucaaugacaaggggaaagaagugcuuguccuguggggagugcaccaccccuccacaucugccgaucaacagagccucuaccagaacgcugacgccuacguguucgucggcaccuccagauauagcaagaaauuuaagcgggagauugcuauccgcccuaaaguuagagaucaggaggggcggaugaauuacuauuggacacugguggaaccgggagacaagauuaccuucgaggccacgggcaaccugguggucccccgcuacgcguuugccauggaaagaaacgcugggucuggaaucauuaucuccgauacaccugugcaugacugcaauaccacaugucaaacccccaaaggcgccaucaacaccagccucccuuuccagaauauucaccccaucacaauuggcaagugcccgaaguauguuaaaucuacgaagcugcggcuugcuaccgggcugcgcaacgugccuagcauccaguccagaggacucuuuggcgccauugccggguucaucgagggaggcuggacagggauggucgacggaugguacggcuaucaucaccagaaugaacaaggcucuggguacgcugcggaucugaaaagcacccagcacgccaucgacgagauuacaaacaaggugaauagcguuaucgagaaaaugaacacccaguuuacggcugugggaaaggaguucaaucaucuugagaagcggauugaaaaccugaauaaaaaggucgaugacggcuuccucgauaucuggacauacaacgccgagcugcuggugcuccuggaaaaugagcgcacccuugacuaucacgauagcaacgucaaaaaucuguacgagaaggugagaucucagcucaaaaacaacgccaaggaaauugggaauggauguuuugaguucuaucauaagugcgacaacaccuguauggaauccguuaaaaauggcacauacgauuaucccaaguacagcgaggaagcuaaacugaaccgggaggagaucaauggggugaaacuugaaucuacccgcaucuaucaaauucuggccaucuacuccacagucgcgagcucccucgugcugguugugucucugggcgcuauuagcuuuuggaugugcuccaacggaucucuccagugcagaaucuguauuuga

SEQ ID NO: 190560 - RNA, 1701 nt, Artificial Sequence
  derived and/or modified sequence opt5 from hemagglutinin__InfluenzaA__AEO01454
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgacgaccauuggcaagugcccuaaguaugugaaaucuacaaagcucagacuggcuaccgggcuucggaacguucccagcauccagucccgcggacuguuuggcgccauugccggguucaucgagggaggcuggacagggaugguggacggaugguacggcuaucaucaccagaaugaacaaggcucuggguacgcugcggaucucaaaagcacccagaacgccaucgacgagauuacgaauaaggucaacuccgugaucgagaaaaugaauacacaguuuaccgcuguuggaaaggaguucaaccaccuggagaagagaauugaaaaucuuaacaaaaagguggaugacggcuuccuggauaucuggaccuacaaugccgagcuccugguccugcucgaaaacgagcggacacuggacuaucaugauagcaaugugaaaaaccuuuacgagaagguccgcucucagcugaaaaacaaugccaaggaaauugggaacggauguuuugaguucuaucacaagugcgacaauaccuguauggaauccgugaaaaacggcacauacgauuauccuaaguacagcgaggaagcuaaacucaauagagaggagaucgacgggguuaagcuggaaucuacgcggaucuaucaaauucuugccaucuacuccaccguggcgagcucccugguccucgugguuucucugggcgcuauuagcuuuuggaugugcuccaacggaucucugcagugccgcaucuguauuuga

SEQ ID NO: 190561 - RNA, 1701 nt, Artificial Sequence
  derived and/or modified sequence opt5 from hemagglutinin__InfluenzaA__AEO01455
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgaaggaggcuggaccgggaugguugacggaugguacggcuaucaucaccagaaugagcaaggcucuggguacgcugcggaccugaaaagcacacagaacgccauugaugagaucaccaauaaggugaacuccgucauugaaaagaugaauacgcaguuuacagcugugggaaaggaguucaaccaccuugaaaagagaaucgagaaucugaacaaaaagguugacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccgucaaaaacggcaccuacgacuauccuaaguacagcgaagaggcuaaacugaauagagaggaaaucgauggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190562 - RNA, 1701 nt, Artificial Sequence
  derived and/or modified sequence opt5 from hemagglutinin__InfluenzaA__AEO01456
augaaggccauccugauugugcuccuguacaccuucgcuacagccaacgcggacacgcuuugcaucggcuaucacgcuaauaacagcaccgauacagucgacacccugcucgagaaaaauguuacagugacccauuccgugaaccugcuugaagauaagcacaaugggaaacuguguaagcucagaggagucgcuccccugcaucugggcaaaugcaacauugccggguggauccucggaaauccugagugugaaucucugagcacagccuccucuuggagcuacauuguggagaccuccucuagcgacaacggcacgugcuauccgggggauuuuaucgacuacgaagaacuucgggagcagcuguccagcguuucuuccuucgaacgcuuugagaucuuccccaagaccagcucuuggccuaaucacgauuccaacaagggagugacagccgcuuguccccaugccggcgcgaaaucuuuuuauaagaaucucauuuggcuggucaaaaagggcaacagcuacccuaaacuuuccaagagcuauaucaaugacaaggggaaagaagugcugguucucuggggcauucaccaccccuccaccucugccgaucaacagagccuguaccagaacgcugacgccuacguguucgucggaacauccagauauagcaagaaauuuaagccugagaucgcuauucggccgaaagugcgcgaucaggaggggagaaugaauuacuauuggacccugguggaacccggagacaagaucacguucgaggccacaggcaaccucgucguuccucgguacgcguuugccauggaucgcaacgcugggucuggaauuaucaucuccgacgcccccgugcaugacugcaauaccacaugucaaaccccuaaaggcgcuauuaacaccagccugcccuuccagaauauccacccgauuacaaucggcaagugcccuaaguaugugaaaucuacgaaacuuagacuggccaccgggcuccggaacguccccagcauucagucccgcggacuguuuggcgccaucgcuggguucaucgaaggaggcuggacagggaugguggauggaugguacggcuaucaucaccagaaugagcaaggcucuggguacgcggccgaccuuaagagcacccagaacgcuauugaugaaaucacaaauaagguuaacuccgugauugagaaaaugaauacccaguuuacggccgucggaaaggaguucaaccaccuggaaaagagaaucgagaaucucaacaaaaagguggacgauggcuuccuggacauuuggacauacaaugccgaacugcucguucugcuugagaacgaacggacccuggauuaucaugacagcaaugugaaaaaccucuacgagaagguccgcucucagcugaaaaacaaugcuaaggagaucgggaacggauguuuugaguucuaucacaagugcgauaauaccuguauggaguccgugaaaaacggcacauacgacuauccuaaguacagcgaagaggccaaacuuaauagagaagagaucgauggggucaagcuggagucuacccggauuuaucaaauccucgcgauuuacuccacaguggcuagcucccugguucugguggucucucucggcgccaucagcuuuuggaugugcuccaacggaucucugcagugccgcauuuguaucuga

SEQ ID NO: 190563 - RNA, 1701 nt, Artificial Sequence; identical to SEQ ID NO: 190462
  derived and/or modified sequence opt5 from hemagglutinin__InfluenzaA__AEO01457

SEQ ID NO: 190564 - RNA, 1701 nt, Artificial Sequence; identical to SEQ ID NO: 190458
  derived and/or modified sequence opt5 from hemagglutinin__InfluenzaA__AEO01458

SEQ ID NO: 190565 - RNA, 1701 nt, Artificial Sequence; identical to SEQ ID NO: 190458
  derived and/or modified sequence opt5 from hemagglutinin__InfluenzaA__AEO01459

SEQ ID NO: 190566 - RNA, 1701 nt, Artificial Sequence; identical to SEQ ID NO: 187113
  derived and/or modified sequence opt5 from hemagglutinin__InfluenzaA__AEO01461

SEQ ID NO: 190567 - RNA, 1701 nt, Artificial Sequence; identical to SEQ ID NO: 186794
  derived and/or modified sequence opt5 from hemagglutinin__InfluenzaA__AEO01462

SEQ ID NO: 190568 - RNA, 1701 nt, Artificial Sequence; identical to SEQ ID NO: 186046
  derived and/or modified sequence opt5 from hemagglutinin__InfluenzaA__AEO01463

SEQ ID NO: 190569 - RNA, 1701 nt, Artificial Sequence
  derived and/or modified sequence opt5 from hemagglutinin__InfluenzaA__AEO01464
augaaggccauccuggugguccuccuguacaccuucgcuacagccaacgcggacacgcuuugcauuggcuaucacgcuaauaacagcaccgauacaguugacacccugcucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauauuaaugacaaggggaaagaaguucuggugcucuggggaauccaccaccccuccaccucugccgaucaacagagccuguaccagaacgcugacgccuacgucuucgugggcacauccagauauagcaagaaauuuaagccugagauugcuauccggccgaaagugcgcgaucaggaggggagaaugaauuacuauuggacccuggucgaacccggagacaagauuacguucgaggccacaggcaaccucguugugccucgguacgcguuugccauggaucgcaacgcugggucuggaaucauuaucuccgacaccagcgugcaugacugcaauacaaccugucaaacccccaaaggcgccaucaacacaucucugccuuuccagaauauucaccccaucacgauuggcaagugcccgaaguaugucaaaagcaccaaacuuagacuggcuacagggcuccggaacgugccuuccauccagucucgcggacuguuuggcgccauugccggguucaucgaaggaggcuggaccgggaugguugauggaugguacggcuaucaucaccagaaugagcaaggcagcggguacgcugcggaccuuaaguccacacagaacgccaucgaugaaauuaccaauaaggugaacagcgucaucgagaaaaugaauacgcaguuuacagcugugggaaaggaguucaaccaccuggaaaagagaauugagaaucucaacaaaaagguugacgauggcuuccuggacaucuggaccuacaaugccgaacugcucgugcugcuugagaacgaacggacccuggauuaucaugacucuaaugucaaaaaccucuacgagaaggugcgcucccagcugaaaaacaaugccaaggagauugggaacggauguuuugaguucuaucacaagugcgauaauacauguauggagagcgucaaaaacggcaccuacgacuaucccaaguacucugaagaggcuaaacuuaauagagaagagaucgauggggugaagcuggaguccacacggaucuaucaaauucucgccaucuacagcacgguugcguccucucuggugcuggucgugagccucggcgcuauuuccuuuuggaugugcucuaacggaagccugcagugccgcaucuguauuuga

SEQ ID NO: 190570 - RNA, 1701 nt, Artificial Sequence; identical to SEQ ID NO: 190549
  derived and/or modified sequence opt5 from hemagglutinin__InfluenzaA__AEO01465

SEQ ID NO: 190571 - RNA, 1701 nt, Artificial Sequence; identical to SEQ ID NO: 187565
  derived and/or modified sequence opt5 from hemagglutinin__InfluenzaA__AEO01466

SEQ ID NO: 190572 - RNA, 1701 nt, Artificial Sequence; identical to SEQ ID NO: 186046
  derived and/or modified sequence opt5 from hemagglutinin__InfluenzaA__AEO01467

SEQ ID NO: 190573 - RNA, 1701 nt, Artificial Sequence; identical to SEQ ID NO: 186857
  derived and/or modified sequence opt5 from hemagglutinin__InfluenzaA__AEO01468

SEQ ID NO: 190574 - RNA, 1701 nt, Artificial Sequence; identical to SEQ ID NO: 185693
  derived and/or modified sequence opt5 from hemagglutinin__InfluenzaA__AEO01469

SEQ ID NO: 190575 - RNA, 1701 nt, Artificial Sequence
  derived and/or modified sequence opt5 from hemagglutinin__InfluenzaA__AEO01470
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccuggugaucccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 190576 - RNA, 1701 nt, Artificial Sequence; identical to SEQ ID NO: 190402
  derived and/or modified sequence opt5 from hemagglutinin__InfluenzaA__AEO01471

SEQ ID NO: 190577 - RNA, 1701 nt, Artificial Sequence; identical to SEQ ID NO: 187320
  derived and/or modified sequence opt5 from hemagglutinin__InfluenzaA__AEO01472

SEQ ID NO: 190578 - RNA, 1701 nt, Artificial Sequence
  derived and/or modified sequence opt5 from hemagglutinin__InfluenzaA__AEO01473
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccugagggcgccaucaauacaucccuccccuuccagaacauucacccgaucacgauuggcgaaugcccuaaauauguuaagagcaccaagcugagacuugcuacagggcugcggaaugugcccucuauccagagccgcggacucuuuggcgccauugccggguucaucgagggaggcuggaccgggaugguggacggaugguacggcuaucaucaccagaacgagcaaggcuccggguacgcugcggaucugaaaucuacacagaaugccaucgacaagauuaccaacaaagucaauagcgugaucgaaaagaugaacacgcaguuuacagcuguuggaaaagaguucaaucaccuugaaaagagaauugagaaccugaauaagaaaguggaugacggcuuccucgauaucuggaccuacaacgccgaacugcugguccuccuggagaaugagcggacccuugacuaucaugauuccaacgugaagaaccuguacgaaaaaguccgcagccagcucaagaauaacgccaaagagauugggaauggauguuuugaguucuaucacaagugcgacaacacauguauggagucugugaagaauggcaccuacgauuauccuaaauacuccgaagaggcuaagcugaacagagaggaaaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 190579 - RNA, 1701 nt, Artificial Sequence
  derived and/or modified sequence opt5 from hemagglutinin__InfluenzaA__AEO01474
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccgacaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgauaagauuaccaacaaagucaauuccgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacagcaacgugaagaaucuguacgagaaaguccgcucucagcucaagaacaacgccaaggagauugggaauggauguuuugaguucuaucacaaaugcgauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190580 - RNA, 1701 nt, Artificial Sequence
  derived and/or modified sequence opt5 from hemagglutinin__InfluenzaA__AEO01475
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagcacgccaucgacgagauuaccaauaaggucaacagcgugaucgagaaaaugaauacgcaguuuacagcuguuggaaaggaguucaaccaucuugagaagagaauugaaaaucugaacaaaaagguggaugacggcuuccucgauaucuggaccuacaaugccgagcugcugguccuccuggaaaacgagcggacccuugacuaucacgauuccaaugugaaaaaccuguacgagaagguccgcagccagcucaaaaacaaugccaaggaaauugggaacggauguuuugaguucuaucauaagugcgacaauacauguauggaaucugugaaaaacggcaccuacgauuauccuaaguacuccgaggaagcuaaacugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190581 - RNA, 1701 nt, Artificial Sequence
  derived and/or modified sequence opt5 from hemagglutinin__InfluenzaA__AEO01476
augaaggccauccuggugguccuccuguacaccuucagcacagcuaacgccgacacgcuuugcauuggcuaucacgcgaauaacuccaccgauacaguugacaccgugcuggagaagaaugugacagucacccauucugugaaccuccuggaagauaagcacaaugggaaacuuuguaagcugagaggaguugcuccccuccaucugggcaaaugcaacaucgccggguggauucugggaaauccugagugugaaagccucuccacagccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagcugccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 190582 - RNA, 1701 nt, Artificial Sequence
  derived and/or modified sequence opt5 from hemagglutinin__InfluenzaA__AEO01477
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacgcuuucgugggcacauccagauauagcaagaaauuuaagccugagauugccauccggccgaaagugcgcgagcaggaagggagaaugaauuacuauuggacccuggucgagcccggagauaagauuacguucgaagcgacaggcaaccugguugugccucgguacgccuuugcuauggagcgcaacgccgggucuggaaucauuaucuccgacacccccgugcaugauugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgaaggaggcuggaccgggaugguugacggaugguacggcuaucaucaccagaaugagcaaggcucuggguacgcggccgaccugaaaagcacacagaacgcuaucgaugagauuaccaauaaggugaacuccgucaucgaaaagaugaauacgcaguuuacagccgugggaaaggaguucaaccaccuugaaaagagaauugagaaucugaacaaaaagguugacgauggcuuccucgacaucuggaccuacaaugccgaacugcuggugcuccuggagaacgagcggacccuugauuaucaugacagcaaugucaaaaaccuguacgaaaaggugcgcucucagcucaaaaacaaugcuaaggagauugggaacggauguuuugaguucuaucacaagugcgauaauacauguauggaguccgucaaaaacggcaccuacgacuauccuaaguacagcgaagaggccaaacugaauagagaggaaaucgauggggugaaacuugagucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 190583 - RNA, 1701 nt, Artificial Sequence; identical to SEQ ID NO: 187021
  derived and/or modified sequence opt5 from hemagglutinin__InfluenzaA__AEO01478

SEQ ID NO: 190584 - RNA, 1701 nt, Artificial Sequence; identical to SEQ ID NO: 190411
  derived and/or modified sequence opt5 from hemagglutinin__InfluenzaA__AEO01479

SEQ ID NO: 190585 - RNA, 1701 nt, Artificial Sequence; identical to SEQ ID NO: 190458
  derived and/or modified sequence opt5 from hemagglutinin__InfluenzaA__AEO01480

SEQ ID NO: 190586 - RNA, 1701 nt, Artificial Sequence
  derived and/or modified sequence opt5 from hemagglutinin__InfluenzaA__AEO01482
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcaauaacacauguauggaauccgugaagaauggcaccuacgacuauccuaaauacagcgaagaggcuaagcugaacagagaagagaucgaugggguuaaacuugagucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190587 - RNA, 1701 nt, Artificial Sequence
  derived and/or modified sequence opt5 from hemagglutinin__InfluenzaA__AEO01483
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauugacuacgaagaacugcgggagcagcuuagcuccgucagcucuuucgaacgcuuugagaucuuccccaagaccuccagcuggccuaaccacgauucuaauaagggagugacagccgcuuguccccaugccggcgcgaaauccuuuuauaagaaccugaucuggcucguuaaaaagggcaauagcuacccuaaacugucuaaguccuauauuaacgacaaggggaaagaagugcuuguccuguggggaauccaccaccccagcaccuccgccgaucaacagucucucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacaagauuaccaacaaagucaauagcgugaucgagaagaugaacacgcaguuuacagcuguuggaaaggaguucaaucaccuugagaaaagaauugagaaccugaauaagaaaguggaugacggcuuccucgauaucuggaccuacaacgccgaacugcugguccuccuggagaaugaacggacccuugacuaucaugauuccaacgugaagaaccuguacgagaaaguccgcagccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacggcggcuuccagccucgugcuggucgugucccugggcgccauuucuuuuuggaugugcagcaauggaucccuccagugccgcaucuguauuuga

SEQ ID NO: 190588 - RNA, 1701 nt, Artificial Sequence
  derived and/or modified sequence opt5 from hemagglutinin__InfluenzaA__AEO01484
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcgacaucgccggguggauucugggaaacccugagugugaaucucucagcacagcuuccucuuggagcuacaucguggagaccuccucuagcgauaauggcacgugcuauccgggggacuuuauugauuacgaagaacugagagagcagcuuuccagcgucucuuccuucgaacgguuugagaucuuccccaagaccagcucuuggccuaaccacgacuccaauaaaggagugacagccgcuuguccccaugccggcgccaagagcuuuuauaaaaaccugaucuggcucguuaagaaaggcaauucuuacccuaagcuguccaagagcuauauuaacgauaaagggaaggaagugcuuguccuguggggaauccaccaccccuccaccucugccgaccaacagagccucuaccagaaugcugaugccuacguguucgugggcacaucccgcuauagcaaaaaguuuaaaccugagauugcuaucagaccgaagguccgggaccaggaggggcgcaugaacuacuauuggacccugguugaacccggagauaaaauuacguucgaggccacaggcaaucugguggugccuagauacgcguuugccauggaacggaacgcugggucuggaaucauuaucuccgacacccccguccaugacugcaacacaaccugucaaaccccuaagggcgccaucaauacaagccuccccuuccagaacauucacccgaucacgauuggcaagugcccuaaauaugugaagucuaccaaacugcgccuugcuacagggcugagaaauguucccagcauccagucccggggacucuuuggcgccauugccggguucaucgagggaggcuggaccgggaugguggauggaugguacggcuaucaucaccagaacgaacaaggcucuggguacgcugcggaccuuaagagcacacagcacgccaucgaugagauuaccaauaaagucaacuccgugaucgagaagaugaauacgcaguuuacagcuguuggaaaggaguucaaccaucuggagaaacgcauugaaaaucugaacaagaaaguggacgauggcuuccucgacaucuggaccuacaaugccgagcugcugguccuccuggaaaacgagagaacccuugauuaucacgacagcaaugugaagaaccuguacgagaaaguccggucucagcucaagaauaacgccaaggaaauugggaacggauguuuugaguucuaucauaaaugcgauaauacauguauggaauccgugaagaacggcaccuacgacuauccuaaauacagcgaggaagcuaagcugaaucgcgaggagaucgaugggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 190589 - RNA, 1701 nt, Artificial Sequence
  derived and/or modified sequence opt5 from hemagglutinin__InfluenzaA__AEO01485
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauuaccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 190590 - RNA, 1701 nt, Artificial Sequence
  derived and/or modified sequence opt5 from hemagglutinin__InfluenzaA__AEO01487
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuacacuugaaucuacgcggaucuaucaaauucuggccaucuacuccaccguggcgagcucccucguccuggugguuucucugggcgcuauuagcuuuuggaugugcuccaacggaucucuccagugccgcaucuguauuuga

SEQ ID NO: 190591 - RNA, 1701 nt, Artificial Sequence
  derived and/or modified sequence opt5 from hemagglutinin__InfluenzaA__AEO01488
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuuaccauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacggaauuacgaauaaggucaacuccgugaucgagaaaaugaauacacaguuuaccgccguuggcaaggaguucaaccaccuugaaaagagaauugagaaucugaacaaaaagguggaugacggguuccucgauaucuggaccuacaaugcugaacugcugguccuccuggagaacgaacggacacuugacuaucaugauagcaaugugaaaaaccuguacgagaagguccgcucucagcucaaaaacaaugccaaggagauuggaaacggcuguuuugaguucuaucacaagugcgacaauaccuguauggaguccgugaaaaacgggacauacgauuauccuaaguacagcgaagaggccaaacugaauagagaagagaucgacggcguuaaacuugagucuacgcggaucuaucaaauucuggcuaucuacuccaccguggccagcucccucguccuggugguuucucugggagcgauuagcuuuuggaugugcuccaacggcucucuccagugccgcaucuguauuuga

SEQ ID NO: 190592 - RNA, 1701 nt, Artificial Sequence
  derived and/or modified sequence opt5 from hemagglutinin__InfluenzaA__AEO01489
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuucggccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 190593 - RNA, 1701 nt, Artificial Sequence
  derived and/or modified sequence opt5 from hemagglutinin__InfluenzaA__AEO01490
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagaauggcuacagggcuucggaacguucccagcauccagucccgcggacuguuuggcgccauugccggguucaucgagggaggcuggaccgggaugguggacggaugguacggcuaucaucaccagaaugaacaaggcucuggguacgcugcggaucucaaaagcacacagaacgccaucgacgagauuaccaauaaggucaacuccgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauagcaaugugaaaaaccuuuacgagaagguccgcaaccagcugaaaaauaacgccaaggaaauugggaauggauguuuugaguucuaucacaagugcgacaacacauguauggaaucugugaaaaauggcaccuacgauuauccuaaguacuccgaggaagcuaaacucaacagagaggagaucgacgggguuaagcuggaaagcacacggaucuaucaaauucuugccaucuacucuacgguggcguccagccugguccucgugguuucccugggcgcuauuucuuuuuggaugugcagcaauggaucccugcagugccgcaucuguauuuga

SEQ ID NO: 190594 - RNA, 1701 nt, Artificial Sequence
  derived and/or modified sequence opt5 from hemagglutinin__InfluenzaA__AEO01491
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaaguacaaugggaaacuuuguaagcugagaggaguugcuccccuccaccugggcaaaugcaacaucgccggguggauucugggaaauccugagugugaaucucucagcacagccuccucuuggagcuauaucguggagaccuccucuagcgacaacggcacgugcuacccgggggauuuuauugacuaugaagaacugcgggagcagcuuuccagcgucucuuccuucgaacgcuuugagaucuuccccaagaccagcucuuggccuaaucaugauuccaacaagggagugacagccgcuuguccccacgccggcgcgaaaucuuuuuacaagaaucugaucuggcucguuaaaaagggcaacagcuauccuaaacuguccaagagcuacauuaaugacaaggggaaagaagugcuuguccuguggggaauccaucaccccuccaccucugccgaucaacagagccucuaccagaacgcugacgccuauguguucgugggcacauccagauacagcaagaaauuuaagccugagauugcuauccggccgaaaguccgcgaucaggaggggagaaugaauuaucacuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190595 - RNA, 1701 nt, Artificial Sequence; identical to SEQ ID NO: 190462
  derived and/or modified sequence opt5 from hemagglutinin__InfluenzaA__AEO01492

SEQ ID NO: 190596 - RNA, 1701 nt, Artificial Sequence
  derived and/or modified sequence opt5 from hemagglutinin__InfluenzaA__AEO01493
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcucugcuggguccggaauuaucaucagcgauacccccguccaugacugcaacacaaccugucaaaccccuaaaggcgccauuaauacaucucugcccuuccagaacauccacccgauuacgaucggcaagugcccuaaguaugugaaaagcaccaagcucagacuggcuacagggcuucggaauguucccuccauucagucucgcggacuguuuggcgccaucgccggguucaucgagggaggcuggaccgggaugguggacggaugguacggcuaucaucaccagaacgaacaaggcagcggguacgcugcggaucucaaauccacacagaaugccauugacgagaucaccaacaaggucaauagcgugauugagaaaaugaacacgcaguuuacagcuguuggaaaggaguucaaucaccuggagaagagaaucgaaaaccuuaauaaaaagguggaugacggcuuccuggauauuuggaccuacaacgccgagcuccugguccugcucgaaaaugagcggacccuggacuaucaugauucuaacgugaaaaaucuuuacgagaagguccgcucccagcugaaaaacaacgccaaggaaaucgggaauggauguuuugaguucuaucacaagugcgacaacacauguauggaaagcgugaaaaauggcaccuacgauuauccuaaguacucugaggaagcuaaacucaacagagaggagaucgacgggguuaagcuggaauccacacggauuuaucaaauccuugccauuuacagcacgguggcguccucucugguccucgugguuagccugggcgcuaucuccuuuuggaugugcucuaauggaagccugcagugccgcauuuguaucuga

SEQ ID NO: 190597 - RNA, 1701 nt, Artificial Sequence
  derived and/or modified sequence opt5 from hemagglutinin__InfluenzaA__AEO01494
augaaggccauccuggugguccuccuguacaccuucgcuacagccaacgcggacacgcuuugcaccggcuaucacgcuaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcaaccagcucaaaaauaacgccaaggaaaucgggaauggauguuuugaguucuaucacaagugcgacaacaccuguauggaaucugugaaaaauggcacauacgauuauccuaaguacuccgaggaagcuaaacugaacagagaggagauugacgggguuaaacuugaaagcacgcggaucuaucaaauccuggccauuuacucuaccguggcguccagccucguccuggugguuucccugggcgcuaucucuuuuuggaugugcagcaauggaucccuccagugccgcauuuguaucuga

SEQ ID NO: 190598 - RNA, 1701 nt, Artificial Sequence; identical to SEQ ID NO: 187290
  derived and/or modified sequence opt5 from hemagglutinin__InfluenzaA__AEO01496

SEQ ID NO: 190599 - RNA, 1701 nt, Artificial Sequence; identical to SEQ ID NO: 186046
  derived and/or modified sequence opt5 from hemagglutinin__InfluenzaA__AEO01497

SEQ ID NO: 190600 - RNA, 1701 nt, Artificial Sequence; identical to SEQ ID NO: 187290
  derived and/or modified sequence opt5 from hemagglutinin__InfluenzaA__AEO01498

SEQ ID NO: 190601 - RNA, 1701 nt, Artificial Sequence
  derived and/or modified sequence opt5 from hemagglutinin__InfluenzaA__AEO01499
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuacacauccgccgaucaacagucucucuaccagaacgcugacgccuauguguucgugggcaccagcagauacuccaagaaauuuaagccugagaucgcuauucggccgaaaguccgcgaucaggaggggagaaugaauuauuacuggacacugguugaacccggagacaagaucaccuucgaggccacgggcaaccugguggugccucgguaugcguuugccauggaacgcaacgcugggagcggaauuaucaucucugauacacccguccaugacugcaauaccacaugucaaaccccuaaaggcgccauuaacaccucccuccccuuccagaauauccacccgauuacaaucggcaagugcccuaaguacgugaaaagcacgaagcugagacuugcuaccgggcugcggaacguucccucuauucagagccgcggacucuuuggcgccaucgccggguucaucgagggaggcuggacagggaugguggacggaugguauggcuaccaucaccagaaugaacaaggcuccggguacgcugcggaucugaaaucuacccagcacgccauugacgagaucacaaacaaggucaauagcgugauugagaaaaugaacacccaguuuacggcuguuggaaaggaguucaaucaucuugagaagagaaucgaaaaccugaauaaaaagguggaugacggcuuccucgauauuuggacauauaacgccgagcugcugguccuccuggaaaaugagcggacccuugacuaccacgauuccaacgugaaaaaucuguaugagaagguccgcagccagcucaaaaacaacgccaaggaaaucgggaauggauguuuugaguucuaccauaagugcgacaacaccuguauggaaucugugaaaaauggcacauaugauuacccuaaguauuccgaggaagcuaaacugaacagagaggagaucaaugggguuaaacuugaaagcacccggauuuaccaaauccuggccauuuacucuacaguggcguccagccucguccuggugguuucccugggcgcuaucucuuuuuggaugugcagcaacggaucccuccagugccgcauuuguaucuga

SEQ ID NO: 190602 - RNA, 1701 nt, Artificial Sequence; identical to SEQ ID NO: 186794
  derived and/or modified sequence opt5 from hemagglutinin__InfluenzaA__AEO01500

SEQ ID NO: 190603 - RNA, 1701 nt, Artificial Sequence; identical to SEQ ID NO: 186857
  derived and/or modified sequence opt5 from hemagglutinin__InfluenzaA__AEO01501

SEQ ID NO: 190604 - RNA, 1701 nt, Artificial Sequence; identical to SEQ ID NO: 186857
  derived and/or modified sequence opt5 from hemagglutinin__InfluenzaA__AEO01502

SEQ ID NO: 190605 - RNA, 1701 nt, Artificial Sequence; identical to SEQ ID NO: 187113
  derived and/or modified sequence opt5 from hemagglutinin__InfluenzaA__AEO01503

SEQ ID NO: 190606 - RNA, 1701 nt, Artificial Sequence; identical to SEQ ID NO: 187290
  derived and/or modified sequence opt5 from hemagglutinin__InfluenzaA__AEO01505

SEQ ID NO: 190607 - RNA, 1701 nt, Artificial Sequence; identical to SEQ ID NO: 186794
  derived and/or modified sequence opt5 from hemagglutinin__InfluenzaA__AEO01506

SEQ ID NO: 190608 - RNA, 1701 nt, Artificial Sequence; identical to SEQ ID NO: 190402
  derived and/or modified sequence opt5 from hemagglutinin__InfluenzaA__AEO01507

SEQ ID NO: 190609 - RNA, 1701 nt, Artificial Sequence; identical to SEQ ID NO: 187290
  derived and/or modified sequence opt5 from hemagglutinin__InfluenzaA__AEO01508

SEQ ID NO: 190610 - RNA, 1701 nt, Artificial Sequence; identical to SEQ ID NO: 187021
  derived and/or modified sequence opt5 from hemagglutinin__InfluenzaA__AEO01510

SEQ ID NO: 190611 - RNA, 1701 nt, Artificial Sequence
  derived and/or modified sequence opt5 from hemagglutinin__InfluenzaA__AEO01511
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccacguccucuuggagcuacaucguggagaccuccucuagcgacaacggcacaugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcuaagagcuuuuauaaaaaucugaucuggcucguuaaaaagggcaacucuuacccuaaacuguccaagagcuauauuaaugacaaggggaaagaagugcuuguccuguggggaauccaccaccccuccaccucugccgaucaacagagccucuaccagaacgcggacgccuacguguucgugggcacguccagauauagcaagaaauuuaagccugagauugcuauccggccgaaaguccgcgagcaggaagggagaaugaauuacuauuggacacugguugagcccggagauaagauuaccuucgaagccacaggcaaccugguggugccucgguacgcuuuugccauggagcgcaacgcggggucuggaaucauuaucuccgacacccccguccaugauugcaauaccacaugucaaacgccuaaaggcgccaucaacaccagccuccccuuccagaauauucacccgaucacaauuggcaagugcccuaaguaugugaaaucuaccaagcugagacuugcuacagggcugcggaacguucccagcauccagucccgcggacucuuuggcgccauugcuggguucaucgaaggaggcuggaccgggaugguggacggaugguacggcuaucaucaccagaaugagcaaggcucuggguacgccgccgaccugaaaagcacgcagaacgcuaucgauaagauuacaaauaaagucaacuccgugaucgagaagaugaauacccaguuuaccgcgguuggaaaggaguucaaccaccuugagaaaagaauugaaaaucugaacaagaaaguggacgauggcuuccucgacaucuggacauacaaugccgagcugcugguccuccuggaaaacgagcggacccuugauuaucaugacagcaaugugaagaaccuguacgagaaaguccgcucucagcucaagaacaaugcuaaggaaauugggaacggauguuuugaguucuaucacaaaugcgauaauacauguauggaauccgugaagaacggcacguacgacuauccuaaauacagcgaggaagccaagcugaauagagaggagaucgaugggguuaaacuugaaucuacccggaucuaucaaauucuggccaucuacuccacaguggcuagcucccucguccuggugguuucucugggcgccauuagcuuuuggaugugcuccaacggaucucuccagugccgcaucuguauuuga

SEQ ID NO: 190612 - RNA, 1701 nt, Artificial Sequence
  derived and/or modified sequence opt5 from hemagglutinin__InfluenzaA__AEO01512
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauaaauguauggaauccgugaagaacggcacauacgacuauccuaaauacagcgaagaggcuaagcugaauagagaggaaaucgaugggguuaaacuugagucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 190613 - RNA, 1701 nt, Artificial Sequence
  derived and/or modified sequence opt5 from hemagglutinin__InfluenzaA__AEO01513
augaaggccauccuggcugugcuccuguacaccuucgccacagcgaacgcugacacgcuuugcauuggcuaucacgccaauaacagcaccgauacagucgacaccguucuggagaaaaaugugacagugacccauuccgucaacauccucgaagauaagcacaaugggaaacuguguaaacuuagaggaguggcuccccugcaucucggcaaaugcaacauugccggguggauccugggaaauccugagugugaaucucugagcacagccuccucuuggagcuacauuguugagaccuccucuagcgacaacggcacgugcuauccgggggauuuuaucgacuacgaagaacuccgggagcagcuguccagcgugucuuccuucgaacgcuuugagaucuuccccaagaccagcucuuggccuaaucacgauuccaacaagggagucacagcugccuguccccaugcgggcgccaagagcuuuuauaagaaucuuauuuggcuggugaaaaagggcaacucuuacccuaaacucuccaagagcuauaucaaugacaaggggaaagaaguucuggugcuuuggggcauucaccaccccuccaccucugcugaucaacagagccuguaccagaacgccgacgcuuacgucuucgugggauccagcagauauucuaagaaauuuaagccugagaucgccauucggccgaaagugcgcgaucaggaggggagaaugaauuacuauuggacacucgucgaacccggagacaagaucaccuucgaggcgacgggcaaccugguugugccucgguacgccuuugcuauggaacgcaacgccggguccggaauuaucaucagcgauacacccgugcaugacugcaauaccacaugucaaaccccuaaaggcgcuauuaacaccucucugcccuuccagaauauccacccggucacaauuggcaagugcccuaaguaugugaaaagcacgaagcucagacuggccaccgggcuucggaacguucccuccauccagucucgcggacuguuuggcgccauugcuggguucaucgagggaggcuggacagggaugguggacggaugguacggcuaucaucaccagaaugaacaaggcagcggguacgcggccgaucucaaauccacccagaacgcuaucgacgagauuacaaauaaggucaacagcgugaucgagaaaaugaauacccaguuuacggccguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauucuaaugugaaaaaccuuuacgagaagguccgcucccagcugaaaaacaaugcuaaggaaauugggaacggauguuuugaguucuaucacaagugcgacaauaccuguauggaaagcgugaaaaacggcacauacgauuauccuaaguacucugaggaagccaaacucaauagagaggagaucgacgggguuaagcuggaauccacccggaucuaucaaauucuugcgaucuacagcacaguggcuuccucucugguccucgugguuagccugggcgccauuuccuuuuggaugugcucuaacggaagccugcagugccgcaucuguauuuga

SEQ ID NO: 190614 - RNA, 1701 nt, Artificial Sequence
  derived and/or modified sequence opt5 from hemagglutinin__InfluenzaA__AEO01514
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaugcacaaugggaagcuguguaaacugagaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgagcaggaagggagaaugaauuacuauuggacccugguugagcccggagauaaaauuacguucgaagccacaggcaaccugguggugccucgguacgcguuugccauggagcgcaacgcugggucuggaaucauuaucuccgacacccccguccaugauugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccuuaagagcacacagaacgccaucgauaaaauuaccaauaaggucaacuccgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauugggaacggauguuuugaguucuaucacaagugcgauaauacauguauggaauccgugaaaaacggcaccuacgacuauccuaaguacagcgaggaagcuaaacugaauagagaggagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190615 - RNA, 1701 nt, Artificial Sequence; identical to SEQ ID NO: 187880
  derived and/or modified sequence opt5 from hemagglutinin__InfluenzaA__AEO01515

SEQ ID NO: 190616 - RNA, 1701 nt, Artificial Sequence; identical to SEQ ID NO: 190462
  derived and/or modified sequence opt5 from hemagglutinin__InfluenzaA__AEO01516

SEQ ID NO: 190617 - RNA, 1701 nt, Artificial Sequence
  derived and/or modified sequence opt5 from hemagglutinin__InfluenzaA__AEO01517
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccugaaggagccaucaacacaagccuccccuuccagaauauucacccgaucacgauuggcaaaugcccuaaguaugugaagucuaccaaacugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucuuaagagcacacagaacgccaucgacgaaauuaccaauaaagucaacuccgugaucgagaagaugaauacgcaguuuacagcuguugggaaagaguucaaccaccuggaaaagagaauugaaaaucugaacaagaaaguggaugacggauuccucgauaucuggaccuacaaugccgagcugcugguccuccuggagaacgaacggacccuugacuaucaugauagcaaugugaagaaccuguacgagaaaguccgcucucagcucaagaacaaugccaaagaaauuggcaacggguguuuugaguucuaucacaagugcgacaauacauguauggaauccgugaagaacggaaccuacgauuauccuaaauacagcgaggaggcuaagcugaauagagaagagaucgacggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 190618 - RNA, 1701 nt, Artificial Sequence
  derived and/or modified sequence opt5 from hemagglutinin__InfluenzaA__AEO01518
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggauuguuaaaaagggcaacagcuacccuaaacucaauaaguccuauaucaacgacaaggggaaagaagugcugguccuuuggggcauucaccaccccagcaccuccgccgaucaacagucucuguaccagaaugcugacgccuacguguucgugggaacaagcagauauuccaagaaauuuaagccugagaucgcuauucggccgaaaguccgcgaucaggaggggagaaugaacuacuauuggacccucguugaacccggagacaagaucacguucgaggccacaggcaaccugguggugccucgguacgcguuugccauggaacgcaaugcugggagcggaauuaucaucucugauacccccguccaugacugcaacacaaccugucaaaccccuaaaggcgccauuaauacaucccugcccuuccagaacauccacccgauuacgaucggcgagugcccuaaguauguuaagagcaccaaacucagacuggcuacagggcuucggaaugugcccucuauucagagccgcggacuguuuggcgccaucgccggguucaucgaaggaggcuggaccgggaugguggacggaugguacggcuaucaucaccagaacgagcaaggcuccggguacgcugcggaucucaagucuacacagaaugccauugacaaaaucaccaacaaggucaauagcgugauugagaaaaugaacacgcaguuuacagcuguuggaaaggaguucaaucaccuggagaagagaaucgaaaaccuuaauaaaaagguggaugacggcuuccuggauauuuggaccuacaacgccgagcuccugguccugcucgaaaaugagcggacccuggacuaucaugauuccaacgugaaaaaccuuuacgagaagguccgcagccagcugaaaaauaacgccaaggaaaucgggaauggauguuuugaguucuaucacaagugcgacaacacauguauggaaucugugaaaaauggcaccuacgauuauccuaaguacuccgaggaagcuaaacucaacagagaggagaucgacgggguuaagcuggaaagcacacggauuuaucaaauccuugccauuuacucuacgguggcguccagccugguccucgugguuucccugggcgcuaucucuuuuuggaugugcagcaauggaucccugcagugccgcauuuguaucuga

SEQ ID NO: 190619 - RNA, 1701 nt, Artificial Sequence
  derived and/or modified sequence opt5 from hemagglutinin__InfluenzaA__AEO01519
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuucggccugagauugcuauccgcccgaaggucagagagcaggaagggcggaugaauuacuauuggacccugguugagcccggagauaaaauuacguucgaagccacaggcaaccugguggugccucgcuacgcguuugccauggagagaaacgcugggucuggaaucauuaucuccgacacccccguccaugauugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacauccccagcauucaguccagaggacucuuuggcgccaucgccggguucaucgaaggaggcuggaccgggaugguugacggaugguacggcuaucaucaccagaaugagcaaggcucuggguacgcugcggaccuuaagagcacacagaacgccauugaugagaucaccaauaaagugaacuccgucauugaaaagaugaauacgcaguuuacagcugugggaaaagaguucaaccaccuggaaaagcggaucgagaaucugaacaagaaaguugacgauggcuuccucgacauuuggaccuacaaugccgaacugcuggugcuccuggagaacgagcgcacccuugauuaucaugacagcaaugucaagaaccuguacgaaaaagugagaucucagcucaagaacaaugccaaagagaucgggaacggauguuuugaguucuaucacaagugcgauaauacauguauggaguccgucaagaacggcaccuacgacuauccuaaauacagcgaagaggcuaagcugaaucgggaggaaaucgauggggugaaacuugagucuacacgcauuuaucaaauccuggccauuuacuccacgguugcgagcucccucgugcuggucgugucucugggcgcuaucagcuuuuggaugugcuccaacggaucucuccagugcagaauuuguaucuga

SEQ ID NO: 190620 - RNA, 1701 nt, Artificial Sequence; identical to SEQ ID NO: 188598
  derived and/or modified sequence opt5 from hemagglutinin__InfluenzaA__AEO01520

SEQ ID NO: 190621 - RNA, 1701 nt, Artificial Sequence; identical to SEQ ID NO: 187320
  derived and/or modified sequence opt5 from hemagglutinin__InfluenzaA__AEO01521

SEQ ID NO: 190622 - RNA, 1701 nt, Artificial Sequence; identical to SEQ ID NO: 189112
  derived and/or modified sequence opt5 from hemagglutinin__InfluenzaA__AEO01522

SEQ ID NO: 190623 - RNA, 1701 nt, Artificial Sequence; identical to SEQ ID NO: 186857
  derived and/or modified sequence opt5 from hemagglutinin__InfluenzaA__AEO01523

SEQ ID NO: 190624 - RNA, 1701 nt, Artificial Sequence; identical to SEQ ID NO: 190451
  derived and/or modified sequence opt5 from hemagglutinin__InfluenzaA__AEO01524

SEQ ID NO: 190625 - RNA, 1701 nt, Artificial Sequence
  derived and/or modified sequence opt5 from hemagglutinin__InfluenzaA__AEO01525
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuagacuguccaaaagcuauauuaaugauaagggaaaggaagugcuuguccuguggggcauccaccaccccuccaccucugccgaccaacagagccucuaccagaacgcugaugccuacguguucguggggacaucccgguauagcaaaaaguuuaaaccugagauugcuauccgcccgaaggucagagaccaggagggacggaugaauuacuauuggacccugguugaacccggcgauaaaauuacguucgaggccacagggaaccugguggugccucgcuacgcguuugccauggaaagaaacgcuggaucuggcaucauuaucuccgacacccccguccaugauugcaauacaaccugucaaaccccuaagggcgccaucaacacaagccuccccuuccagaauauucacccgaucacgauugggaaaugcccuaaguaugugaagucuaccaaacugcggcuugcuacaggacugcgcaacguucccagcauccaguccagaggccucuuuggggccauugccggauucaucgagggcggguggaccggaaugguggacggcugguacggcuaucaucaccagaaugaacaagggucuggauacgcugcggaccuuaagagcacacagaacgccaucgaugagauuaccaauaaagucaacuccgugaucgagaagaugaauacgcaguuuacagcuguuggcaaagaguucaaccaccuggagaagcggauugaaaaucugaacaagaaaguggacgauggguuccucgacaucuggaccuacaaugccgagcugcugguccuccuggaaaacgagcgcacccuugauuaucaugacagcaaugugaagaaccuguacgagaaagucagaucucagcucaagaacaaugccaaagaaauuggaaacggcuguuuugaguucuaucacaagugcgauaauacauguauggaauccgugaagaacgggaccuacgacuauccuaaauacagcgaggaagcuaagcugaaucgggaggagaucgauggcguuaaacuugaaucuacacgcaucuaucaaauucuggccaucuacuccacgguggcgagcucccucguccuggugguuucucugggagcuauuagcuuuuggaugugcuccaacggcucucuccagugcagaaucuguauuuga

SEQ ID NO: 190626 - RNA, 1701 nt, Artificial Sequence; identical to SEQ ID NO: 186857
  derived and/or modified sequence opt5 from hemagglutinin__InfluenzaA__AEO01526

SEQ ID NO: 190627 - RNA, 1701 nt, Artificial Sequence; identical to SEQ ID NO: 189634
  derived and/or modified sequence opt5 from hemagglutinin__InfluenzaA__AEO01527

SEQ ID NO: 190628 - RNA, 1701 nt, Artificial Sequence
  derived and/or modified sequence opt5 from hemagglutinin__InfluenzaA__AEO01529
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaguggggaacggauguuuugaguucuaucacaagugcgacaauaccuguauggaaagcguuaaaaacggcacauacgauuauccuaaguacucugaggaagcuaaacucaauagagagaagaucgacggggugaaacuggaguccacccggaucuaucaaauucuugccaucuacagcacagcggcuuccucucugguccucgugguuagccugggcgccauuuccuuuuggaugugcucuaacggaagccugcagugccgcaucuguauuuga

SEQ ID NO: 190629 - RNA, 1701 nt, Artificial Sequence; identical to SEQ ID NO: 186857
  derived and/or modified sequence opt5 from hemagglutinin__InfluenzaA__AEO01530

SEQ ID NO: 190630 - RNA, 1701 nt, Artificial Sequence
  derived and/or modified sequence opt5 from hemagglutinin__InfluenzaA__AEO01531
augaaggccauccuggugguccuccuguacaccuucgcuacagccaacacggacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgagcaggaagggagaaugaauuacuauuggacgcugguugagcccggagauaagauuacauucgaagcuaccggcaaccugguggugccucgguacgccuuugcgauggagcgcaacgccgggucuggaaucauuaucuccgacacacccguccaugauugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgaaggaggcuggacagggaugguggacggaugguacggcuaucaucaccagaaugagcaaggcucuggguacgccgcugaccugaaaagcacccagaacgcgaucgauaagauuacgaauaaagucaacuccgugaucgagaagaugaauacacaguuuaccgccguuggaaaggaguucaaccaccuugagaaaagaauugaaaaucugaacaagaaaguggacgauggcuuccucgacaucuggaccuacaaugcugagcugcugguccuccuggaaaacgagcggacacuugauuaucaugacagcaaugugaagaaccuguacgagaaaguccgcucucagcucaagaacaaugccaaggaaauugggaacggauguuuugaguucuaucacaaaugcgauaauaccuguauggaauccgugaagaacggcacauacgacuauccuaaauacagcgaggaagccaagcugaauagagaggagaucgaugggguuaaacuugaaucuacgcggguguaucaaauccuggcuauuuacuccaccgucgccagcucccucgugcugguugugucucugggcgcgaucagcuuuuggaugugcuccaacggaucucuccagugccgcauuuguaucuga

SEQ ID NO: 190631 - RNA, 1701 nt, Artificial Sequence; identical to SEQ ID NO: 190462
  derived and/or modified sequence opt5 from hemagglutinin__InfluenzaA__AEO01532

SEQ ID NO: 190632 - RNA, 1701 nt, Artificial Sequence
  derived and/or modified sequence opt5 from hemagglutinin__InfluenzaA__AEO01533
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 190633 - RNA, 1701 nt, Artificial Sequence
  derived and/or modified sequence opt5 from hemagglutinin__InfluenzaA__AEO01534
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagcccgguccuggucuuacaucguggagaccagcuccucugacaacggcacgugcuauccgggggauuuuauugacuacgaagaacugcgcgagcagcuuagcuccgucagcucuuucgaaagauuugagaucuuccccaagaccuccagcuggccuaaucacgauucuaacaagggagugacagccgcuuguccccaugccggcgcgaaauccuuuuauaagaaucugaucuggcucguuaaaaagggcaacagcuacccuaaacugucuaaguccuauauuaaugacaaggggaaagaagugcuuguccuguggggaauccaccaccccagcaccuccgccgaucaacagucucucuaccagaacgcugacgccuacguguucgugggcacaagccgguauuccaagaaauuuaagccugagauugcuauccgcccgaaagucagagaucaggaggggcggaugaauuacuauuggacccugguugaacccggagacaagauuacguucgaggccacaggcaaccugguggugccucgcuacgcguuugccauggaaagaaacgcugggagcggaaucauuaucucugauacccccguccaugacugcaauacaaccugucaaaccccuaaaggcgccaucaacacaucccuccccuuccagaauauucacccgaucacgauuggcaagugcccuaaguaugugaaaagcaccaagcugcggcuugcuacagggcugcgcaacguucccucuauccagagcagaggacucuuuggcgccauugccggguucaucgagggaggcuggaccgggaugguggacggaugguacggcuaucaucaccagaaugaacaaggcuccggguacgcugcggaucugaaaucuacacagcacgccaucgacgagauuaccaacaaggucaauagcgugaucgagaaaaugaacacgcaguuuacagcuguuggaaaggaguucaaucaucuugagaagcggauugaaaaccugaauaaaaagguggaugacggcuuccucgauaucuggaccuacaacgccgagcugcugguccuccuggaaaaugagcgcacccuugacuaucacgauuccaacgugaaaaaucuguacgagaaggucagaagccagcucaaaaacaacgccaaggaaauugggaauggauguuuugaguucuaucauaagugcgacaacacauguauggaaucugugaaaaauggcaccuacgauuauccuaaguacuccgaggaagcuaaacugaaccgggaggagaucgacgggguuaaacuugaaagcacacgcaucuaucaaauucuggccaucuacucuacgguggcguccagccucguccuggugguuucccugggcgcuauuucuuuuuggaugugcagcaauggaucccuccagugcagaaucuguauuuga

SEQ ID NO: 190634 - RNA, 1701 nt, Artificial Sequence; identical to SEQ ID NO: 187342
  derived and/or modified sequence opt5 from hemagglutinin__InfluenzaA__AEO01535

SEQ ID NO: 190635 - RNA, 1701 nt, Artificial Sequence; identical to SEQ ID NO: 186857
  derived and/or modified sequence opt5 from hemagglutinin__InfluenzaA__AEO01536

SEQ ID NO: 190636 - RNA, 1701 nt, Artificial Sequence; identical to SEQ ID NO: 188598
  derived and/or modified sequence opt5 from hemagglutinin__InfluenzaA__AEO01537

SEQ ID NO: 190637 - RNA, 1701 nt, Artificial Sequence
  derived and/or modified sequence opt5 from hemagglutinin__InfluenzaA__AEO01538
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggagauuuuauugacuacgaagaacugagagagcagcuuuccagcgucucuuccuucgaacgguuugagaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaagugcuuguccuguggggcauccaccaccccuccaccucugccgaucaacagagccucuaccagaacgcugacgccuacguguucguggggacaucccgcuauagcaagaaauuuaagccugagauugcuaucagaccgaaaguccgggaucaggagggacgcaugaauuacuauuggacccugguugaacccggcgacaagauuacguucgaggccacagggaaccugguggugccuagauacgcguuugccauggaacggaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaucugaaaagcacacagaacgccaucgacgagauuaccaauaaggucaacuccgugaucgagaaaaugaauacgcaguuuacagcuguuggcaaggaguucaaccaccuugagaagcgcauugaaaaucugaacaaaaagguggaugacggguuccucgauaucuggaccuacaaugccgagcugcugguccuccuggaaaacgagagaacccuugacuaucaugauagcaaugugaaaaaccuguacgagaagguccggucucagcucaaaaacaaugccaaggaaauuggaaacggcuguuuugaguucuaucacaagugcgacaauacauguauggaauccgugaaaaacgggaccuacgauuauccuaaguacagcgaggaagcuaaacugaaucgcgaggagaucgacggcguuaaacuugaaucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 190638 - RNA, 1701 nt, Artificial Sequence; identical to SEQ ID NO: 187320
  derived and/or modified sequence opt5 from hemagglutinin__InfluenzaA__AEO01539

SEQ ID NO: 190639 - RNA, 1701 nt, Artificial Sequence
  derived and/or modified sequence opt5 from hemagglutinin__InfluenzaA__AEO01540
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugagaaacuuuguaagcugagagggguugcuccccuccaucugggaaaaugcaacauugccggcuggauccuggggaauccugaaugugagucucucagcaccgccuccucuuggagcuacauuguggaaacauccucuagcgacaacggaaccugcuauccgggcgauuuuaucgacuacgaggagcugcgggaacagcuuuccagcgucucuuccuucgagcgcuuugaaaucuuccccaagacgagcucuuggccuaaucacgauuccaacaagggggugaccgccgcuuguccccaugccggagcgaaaucuuuuuauaagaaucugauuuggcucguuaaaaagggcaacagcuacccuaaacuguccaagagcuauaucaaugacaagggcaaagaggugcuuguccugugggggauucaccaccccuccacaucugccgaucaacagagccucuaccagaacgcugacgccuacguguucgugggaaccuccagauauagcaagaaauuuaagccugagaucgcuauucggccgaaaguccgcgaucaggaaggcagaaugaauuacuauuggacacugguugagcccggggacaagaucaccuucgaagccacgggaaaccugguggugccucgguacgcguuugccauggagcgcaacgcuggcucugggauuaucaucuccgauacacccguccaugacugcaauaccacaugucaaaccccuaaaggagccauuaacaccagccuccccuuccagaauauccacccgauuacaaucggcaagugcccuaaguaugugaaaucuacgaagcugagacuugcuaccggccugcggaacguucccagcauucagucccgcgggcucuuuggagccaucgccggcuucaucgaagggggauggacaggcaugguggacgggugguacggauaucaucaccagaaugagcaaggcucuggcuacgcugcggaucugaaaagcacccagcacgccauugacgagaucacaaacaaggucaauuccgugauugaaaagaugaacacccaguuuacggcuguugggaaggaguucaaucaucuugaaaagagaaucgagaaccugaauaaaaagguggaugacggauuccucgauauuuggacauacaacgccgaacugcugguccuccuggagaaugagcggacccuugacuaucacgauagcaacgugaaaaaucuguacgaaaagguccgcucucagcucaaaaacaacgccaaggagaucggcaauggguguuuugaguucuaucauaagugcgacaacaccuguauggaauccgugaaaaauggaacauacgauuauccuaaguacagcgaagaggcuaaacugaacagagaggaaaucaauggcguuaaacuugagucuacccggauuuaucaaauccuggccauuuacuccacaguggcgagcucccucguccuggugguuucucugggggcuaucagcuuuuggaugugcuccaacggcucucuccagugccgcauuuguaucuga

SEQ ID NO: 190640 - RNA, 1701 nt, Artificial Sequence; identical to SEQ ID NO: 187113
  derived and/or modified sequence opt5 from hemagglutinin__InfluenzaA__AEO01541

SEQ ID NO: 190641 - RNA, 1701 nt, Artificial Sequence; identical to SEQ ID NO: 186857
  derived and/or modified sequence opt5 from hemagglutinin__InfluenzaA__AEO01542

SEQ ID NO: 190642 - RNA, 1701 nt, Artificial Sequence; identical to SEQ ID NO: 186794
  derived and/or modified sequence opt5 from hemagglutinin__InfluenzaA__AEO01543

SEQ ID NO: 190643 - RNA, 1701 nt, Artificial Sequence; identical to SEQ ID NO: 186794
  derived and/or modified sequence opt5 from hemagglutinin__InfluenzaA__AEO01544

SEQ ID NO: 190644 - RNA, 1701 nt, Artificial Sequence
  derived and/or modified sequence opt5 from hemagglutinin__InfluenzaA__AEO01545
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacucugggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcacgugcuauccgggggauuuugucgacuacgaagaacugcgggagcagcuuagcucuguguccagcuucgaacgcuuugagauuuuccccaagaccucuuccuggccuaaccacgauagcaauaagggaguuacagccgcuuguccccaugccggcgcgaaaucuuuuuauaagaaccugaucuggcucgugaaaaagggcaauuccuacccuaaacugagcaaguccuauaucaacgacaaggggaaagaaguccuugugcuguggggcauucaccaccccucuaccagcgccgaucaacagucccucuaccagaaugcugacgccuacguguucgucggaacaagcagauauucuaagaaauuuaagccugagaucgcuauucggccgaaaguucgcgaucaggaggggagaaugaacuacuauuggacccugguggaacccggagacaagaucacguucgaggccacaggcaaucugguggucccucgguacgcguuugccauggaacgcaacgcuggguccggaauuaucauuagcgauacccccgugcaugacugcaacacaaccugucaaaccccuaaaggcgccaucaauacaucucuccccuuccagaacauccacccgauuacgaucggcaagugcccuaaguauguuaaaagcaccaagcugagacuugcuacagggcugcggaaugugcccuccauucagucucgcggacucuuuggcgccaucgccggguucauugagggaggcuggaccgggauggucgacggaugguacggcuaucaucaccagaacgaacaaggcagcggguacgcugcggaucugaaauccacacagaaugccaucgacaagaucaccaacaaagugaauagcguuauugagaagaugaacacgcaguuuacagcugugggaaaggaguucaaucaccuugagaaaagaaucgagaaccugaauaagaaagucgaugacggcuuccucgauauuuggaccuacaacgccgaacugcuggugcuccuggagaaugaacggacccuugacuaucaugauucuaacgucaagaaucuguacgagaaagugcgcucccagcucaagaacaacgccaaggagaucgggaauggauguuuugaguucuaucacaaaugcgacaacacauguauggaaagcguuaagaauggcaccuacgauuauccuaaauacucugaagaggcuaagcugaacagagaagagauugacggggugaaacuugaguccacacggaucuaucaaauccuggccauuuacagcacggucgcguccucucucgugcugguugugagccugggcgcuaucuccuuuuggaugugcucuaauggaagccuccagugccgcauuuguaucuga

SEQ ID NO: 190645 - RNA, 1701 nt, Artificial Sequence; identical to SEQ ID NO: 185680
  derived and/or modified sequence opt5 from hemagglutinin__InfluenzaA__AEO01546

SEQ ID NO: 190646 - RNA, 1701 nt, Artificial Sequence; identical to SEQ ID NO: 185680
  derived and/or modified sequence opt5 from hemagglutinin__InfluenzaA__AEO01547

SEQ ID NO: 190647 - RNA, 1701 nt, Artificial Sequence; identical to SEQ ID NO: 185873
  derived and/or modified sequence opt5 from hemagglutinin__InfluenzaA__AEO01548

SEQ ID NO: 190648 - RNA, 1701 nt, Artificial Sequence; identical to SEQ ID NO: 185784
  derived and/or modified sequence opt5 from hemagglutinin__InfluenzaA__AEO01549

SEQ ID NO: 190649 - RNA, 1701 nt, Artificial Sequence; identical to SEQ ID NO: 185693
  derived and/or modified sequence opt5 from hemagglutinin__InfluenzaA__AEO01550

SEQ ID NO: 190650 - RNA, 1701 nt, Artificial Sequence; identical to SEQ ID NO: 185693
  derived and/or modified sequence opt5 from hemagglutinin__InfluenzaA__AEO01551

SEQ ID NO: 190651 - RNA, 1701 nt, Artificial Sequence; identical to SEQ ID NO: 185693
  derived and/or modified sequence opt5 from hemagglutinin__InfluenzaA__AEO01552

SEQ ID NO: 190652 - RNA, 1701 nt, Artificial Sequence; identical to SEQ ID NO: 185693
  derived and/or modified sequence opt5 from hemagglutinin__InfluenzaA__AEO01553

SEQ ID NO: 190653 - RNA, 1701 nt, Artificial Sequence; identical to SEQ ID NO: 185693
  derived and/or modified sequence opt5 from hemagglutinin__InfluenzaA__AEO01554

SEQ ID NO: 190654 - RNA, 1701 nt, Artificial Sequence; identical to SEQ ID NO: 185873
  derived and/or modified sequence opt5 from hemagglutinin__InfluenzaA__AEO01555

SEQ ID NO: 190655 - RNA, 1701 nt, Artificial Sequence; identical to SEQ ID NO: 185693
  derived and/or modified sequence opt5 from hemagglutinin__InfluenzaA__AEO01557

SEQ ID NO: 190656 - RNA, 1701 nt, Artificial Sequence; identical to SEQ ID NO: 185693
  derived and/or modified sequence opt5 from hemagglutinin__InfluenzaA__AEO01558

SEQ ID NO: 190657 - RNA, 1701 nt, Artificial Sequence
  derived and/or modified sequence opt5 from hemagglutinin__InfluenzaA__AEO01559
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaagacugcaauacaaccugucagaccccuaaaggcgccaucaacacaagccuccccuuccagaauauucauccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaccaucaaaaugaacagggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucacgauagcaaugugaaaaaccuguacgagaagguccgcucucaacucaaaaacaaugccaaggaaauugggaacggauguuuugaguucuaucauaagugcgacaauacauguauggaauccgugaaaaacggcaccuacgauuauccuaaguacagcgaggaagcuaaacugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 190658 - RNA, 1701 nt, Artificial Sequence; identical to SEQ ID NO: 185693
  derived and/or modified sequence opt5 from hemagglutinin__InfluenzaA__AEO01560

SEQ ID NO: 190659 - RNA, 1701 nt, Artificial Sequence; identical to SEQ ID NO: 185693
  derived and/or modified sequence opt5 from hemagglutinin__InfluenzaA__AEO01561

SEQ ID NO: 190660 - RNA, 1701 nt, Artificial Sequence; identical to SEQ ID NO: 185693
  derived and/or modified sequence opt5 from hemagglutinin__InfluenzaA__AEO01562

SEQ ID NO: 190661 - RNA, 1701 nt, Artificial Sequence; identical to SEQ ID NO: 185693
  derived and/or modified sequence opt5 from hemagglutinin__InfluenzaA__AEO01563

SEQ ID NO: 190662 - RNA, 1701 nt, Artificial Sequence; identical to SEQ ID NO: 185693
  derived and/or modified sequence opt5 from hemagglutinin__InfluenzaA__AEO01564

SEQ ID NO: 190663 - RNA, 1701 nt, Artificial Sequence; identical to SEQ ID NO: 185693
  derived and/or modified sequence opt5 from hemagglutinin__InfluenzaA__AEO01565

SEQ ID NO: 190664 - RNA, 1701 nt, Artificial Sequence; identical to SEQ ID NO: 185680
  derived and/or modified sequence opt5 from hemagglutinin__InfluenzaA__AEO01566

SEQ ID NO: 190665 - RNA, 1701 nt, Artificial Sequence; identical to SEQ ID NO: 185935
  derived and/or modified sequence opt5 from hemagglutinin__InfluenzaA__AEO01567

SEQ ID NO: 190666 - RNA, 1701 nt, Artificial Sequence; identical to SEQ ID NO: 185875
  derived and/or modified sequence opt5 from hemagglutinin__InfluenzaA__AEO01568

SEQ ID NO: 190667 - RNA, 1701 nt, Artificial Sequence; identical to SEQ ID NO: 185875
  derived and/or modified sequence opt5 from hemagglutinin__InfluenzaA__AEO01569

SEQ ID NO: 190668 - RNA, 1701 nt, Artificial Sequence; identical to SEQ ID NO: 185935
  derived and/or modified sequence opt5 from hemagglutinin__InfluenzaA__AEO01570

SEQ ID NO: 190669 - RNA, 1701 nt, Artificial Sequence; identical to SEQ ID NO: 185875
  derived and/or modified sequence opt5 from hemagglutinin__InfluenzaA__AEO01571

SEQ ID NO: 190670 - RNA, 1701 nt, Artificial Sequence; identical to SEQ ID NO: 185935
  derived and/or modified sequence opt5 from hemagglutinin__InfluenzaA__AEO01572

SEQ ID NO: 190671 - RNA, 1701 nt, Artificial Sequence; identical to SEQ ID NO: 185680
  derived and/or modified sequence opt5 from hemagglutinin__InfluenzaA__AEO01573

SEQ ID NO: 190672 - RNA, 1701 nt, Artificial Sequence; identical to SEQ ID NO: 185693
  derived and/or modified sequence opt5 from hemagglutinin__InfluenzaA__AEO01574

SEQ ID NO: 190673 - RNA, 1701 nt, Artificial Sequence; identical to SEQ ID NO: 185680
  derived and/or modified sequence opt5 from hemagglutinin__InfluenzaA__AEO01575

SEQ ID NO: 190674 - RNA, 1701 nt, Artificial Sequence; identical to SEQ ID NO: 185680
  derived and/or modified sequence opt5 from hemagglutinin__InfluenzaA__AEO01576

SEQ ID NO: 190675 - RNA, 1701 nt, Artificial Sequence; identical to SEQ ID NO: 185680
  derived and/or modified sequence opt5 from hemagglutinin__InfluenzaA__AEO01577

SEQ ID NO: 190676 - RNA, 1701 nt, Artificial Sequence; identical to SEQ ID NO: 185935
  derived and/or modified sequence opt5 from hemagglutinin__InfluenzaA__AEO01578

SEQ ID NO: 190677 - RNA, 1701 nt, Artificial Sequence; identical to SEQ ID NO: 185935
  derived and/or modified sequence opt5 from hemagglutinin__InfluenzaA__AEO01579

SEQ ID NO: 190678 - RNA, 1701 nt, Artificial Sequence; identical to SEQ ID NO: 185680
  derived and/or modified sequence opt5 from hemagglutinin__InfluenzaA__AEO01581

SEQ ID NO: 190679 - RNA, 1701 nt, Artificial Sequence; identical to SEQ ID NO: 185680
  derived and/or modified sequence opt5 from hemagglutinin__InfluenzaA__AEO01582

SEQ ID NO: 190680 - RNA, 1701 nt, Artificial Sequence; identical to SEQ ID NO: 185680
  derived and/or modified sequence opt5 from hemagglutinin__InfluenzaA__AEO01583

SEQ ID NO: 190681 - RNA, 1701 nt, Artificial Sequence; identical to SEQ ID NO: 185680
  derived and/or modified sequence opt5 from hemagglutinin__InfluenzaA__AEO01584

SEQ ID NO: 190682 - RNA, 1701 nt, Artificial Sequence; identical to SEQ ID NO: 185680
  derived and/or modified sequence opt5 from hemagglutinin__InfluenzaA__AEO01585

SEQ ID NO: 190683 - RNA, 1701 nt, Artificial Sequence; identical to SEQ ID NO: 185680
  derived and/or modified sequence opt5 from hemagglutinin__InfluenzaA__AEO01586

SEQ ID NO: 190684 - RNA, 1701 nt, Artificial Sequence; identical to SEQ ID NO: 185680
  derived and/or modified sequence opt5 from hemagglutinin__InfluenzaA__AEO01587

SEQ ID NO: 190685 - RNA, 1701 nt, Artificial Sequence; identical to SEQ ID NO: 185680
  derived and/or modified sequence opt5 from hemagglutinin__InfluenzaA__AEO01588

SEQ ID NO: 190686 - RNA, 1701 nt, Artificial Sequence; identical to SEQ ID NO: 185693
  derived and/or modified sequence opt5 from hemagglutinin__InfluenzaA__AEO01589

SEQ ID NO: 190687 - RNA, 1701 nt, Artificial Sequence; identical to SEQ ID NO: 185693
  derived and/or modified sequence opt5 from hemagglutinin__InfluenzaA__AEO01590

SEQ ID NO: 190688 - RNA, 1701 nt, Artificial Sequence; identical to SEQ ID NO: 185693
  derived and/or modified sequence opt5 from hemagglutinin__InfluenzaA__AEO01591

SEQ ID NO: 190689 - RNA, 1701 nt, Artificial Sequence; identical to SEQ ID NO: 185680
  derived and/or modified sequence opt5 from hemagglutinin__InfluenzaA__AEO01592

SEQ ID NO: 190690 - RNA, 1701 nt, Artificial Sequence; identical to SEQ ID NO: 185693
  derived and/or modified sequence opt5 from hemagglutinin__InfluenzaA__AEO01593

SEQ ID NO: 190691 - RNA, 1701 nt, Artificial Sequence; identical to SEQ ID NO: 185680
  derived and/or modified sequence opt5 from hemagglutinin__InfluenzaA__AEO01594

SEQ ID NO: 190692 - RNA, 1701 nt, Artificial Sequence; identical to SEQ ID NO: 185680
  derived and/or modified sequence opt5 from hemagglutinin__InfluenzaA__AEO01595

SEQ ID NO: 190693 - RNA, 1701 nt, Artificial Sequence; identical to SEQ ID NO: 185873
  derived and/or modified sequence opt5 from hemagglutinin__InfluenzaA__AEO01596

SEQ ID NO: 190694 - RNA, 1701 nt, Artificial Sequence; identical to SEQ ID NO: 185693
  derived and/or modified sequence opt5 from hemagglutinin__InfluenzaA__AEO01597

SEQ ID NO: 190695 - RNA, 1701 nt, Artificial Sequence
  derived and/or modified sequence opt5 from hemagglutinin__InfluenzaA__AEO01598
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaauggagugacagccgcuuguccccaugccggcgccaagagcuuuuauaaaaaccugaucuggcucguuaagaaaggcaauucuuacccuaagcuguccaaaagcuauaucaacgacaaggggaaggaagugcuuguccuguggggcauucaccaccccuccaccucugccgaucaacagagccucuaccagaaugcugacgccuacguguucgugggauccagcagauauucuaaaaaguuuaaaccugagaucgcuauucggccgaagguccgcgaucaggaggggagaaugaacuacuauuggacacugguugaacccggagacaaaaucaccuucgaggccacgggcaaccugguggugccucgguacgcguuugccauggaacgcaaugcuggguccggaauuaucauuagcgauacacccguccaugacugcaacaccacaugucaaaccccuaagggcgccaucaauaccucucuccccuuccagaacauccacccgauuacaaucggcaaaugcccuaaguauguuaagagcacgaaacugagacuugcuaccgggcugcggaaugugcccuccauucagucucgcggacucuuuggcgccaucgccggguucauugagggaggcuggacagggaugguggacggaugguacggcuaucaucaccagaacgaacaaggcagcggguacgcugcggaucugaaguccacccagaaugccaucgacgagaucacaaacaaagucaauagcgugauugagaagaugaacacccaguuuacggcuguuggaaaagaguucaaucaccuugagaagagaaucgaaaaccugaauaagaaaguggaugacggcuuccucgauauuuggacauacaacgccgagcugcugguccuccuggaaaaugagcggacccuugacuaucaugauucuaacgugaagaaccuguacgagaaaguccgcucccagcucaagaauaacgccaaagaaaucgggaauggauguuuugaguucuaucacaagugcgacaacaccuguauggaaagcgugaagaauggcacauacgauuauccuaaauacucugaggaagcuaagcugaacagagaggagauugacgggguuaaacuugaauccacccggaucuaucaaauccuggccauuuacagcacaguggcguccucucucguccuggugguuagccugggcgcuaucuccuuuuggaugugcucuaauggaagccuccagugccgcauuuguaucuga

SEQ ID NO: 190696 - RNA, 1701 nt, Artificial Sequence; identical to SEQ ID NO: 185693
  derived and/or modified sequence opt5 from hemagglutinin__InfluenzaA__AEO01599

SEQ ID NO: 190697 - RNA, 1701 nt, Artificial Sequence; identical to SEQ ID NO: 185693
  derived and/or modified sequence opt5 from hemagglutinin__InfluenzaA__AEO01600

SEQ ID NO: 190698 - RNA, 1701 nt, Artificial Sequence; identical to SEQ ID NO: 185693
  derived and/or modified sequence opt5 from hemagglutinin__InfluenzaA__AEO01601

SEQ ID NO: 190699 - RNA, 1701 nt, Artificial Sequence; identical to SEQ ID NO: 185693
  derived and/or modified sequence opt5 from hemagglutinin__InfluenzaA__AEO01602

SEQ ID NO: 190700 - RNA, 1701 nt, Artificial Sequence; identical to SEQ ID NO: 185693
  derived and/or modified sequence opt5 from hemagglutinin__InfluenzaA__AEO01603

SEQ ID NO: 190701 - RNA, 1701 nt, Artificial Sequence; identical to SEQ ID NO: 185693
  derived and/or modified sequence opt5 from hemagglutinin__InfluenzaA__AEO01604

SEQ ID NO: 190702 - RNA, 1701 nt, Artificial Sequence; identical to SEQ ID NO: 185693
  derived and/or modified sequence opt5 from hemagglutinin__InfluenzaA__AEO01605

SEQ ID NO: 190703 - RNA, 1701 nt, Artificial Sequence
  derived and/or modified sequence opt5 from hemagglutinin__InfluenzaA__AEO01606
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaaggucaaaucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 190704 - RNA, 1701 nt, Artificial Sequence; identical to SEQ ID NO: 185935
  derived and/or modified sequence opt5 from hemagglutinin__InfluenzaA__AEO01607

SEQ ID NO: 190705 - RNA, 1701 nt, Artificial Sequence; identical to SEQ ID NO: 188598
  derived and/or modified sequence opt5 from hemagglutinin__InfluenzaA__AEO01608

SEQ ID NO: 190706 - RNA, 1701 nt, Artificial Sequence; identical to SEQ ID NO: 190458
  derived and/or modified sequence opt5 from hemagglutinin__InfluenzaA__AEO01609

SEQ ID NO: 190707 - RNA, 1701 nt, Artificial Sequence
  derived and/or modified sequence opt5 from hemagglutinin__InfluenzaA__AEO01610
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagcacgcgaucgacgagauuacgaacaaggucaauuccgugaucgagaaaaugaacacacaguuuaccgccguuggaaaggaguucaaucaucuugagaagagaauugaaaaccugaauaaaaagguggaugacggcuuccucgauaucuggaccuacaacgcugagcugcugguccuccuggaaaaugagcggacacuugacuaucacgauagcaacgugaaaaaucuguacgagaagguccgcucucagcucaaaaacaacgccaaggaaauugggaauggauguuuugaguucuaucauaagugcgacaacaccuguauggaauccgugaaaaauggcacauacgauuauccuaaguacagcgaggaagccaaacugaacagagaggagaucgacgggguuaaacuugaaucuacgcggaucuaucaaauucuggcuaucuacuccaccguggccagcucccucguccuggugguuucucugggcgcgauuagcuuuuggaugugcuccaauggaucucuccagugccgcguguguaucuga

SEQ ID NO: 190708 - RNA, 1701 nt, Artificial Sequence
  derived and/or modified sequence opt5 from hemagglutinin__InfluenzaA__AEO01611
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggagagaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcgagugcccuaaauaugugaagucuaccaagcugcggcuugcuacagggcugcgcaacguucccagcauccaguccagaggacucuuuggcgccauugccggguucaucgaaggaggcuggaccgggaugguggacggaugguacggcuaucaucaccagaaugagcaaggcucuggguacgcugcggaucugaaaagcacacagaacgccaucgacaagauuaccaauaaagucaacuccgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacggcggcuagcucccucgugcuggucgugucucugggcgccauuagcuuuuggaugugcuccaacggaucucuccagugcagaaucuguauuuga

SEQ ID NO: 190709 - RNA, 1701 nt, Artificial Sequence
  derived and/or modified sequence opt5 from hemagglutinin__InfluenzaA__AEO01612
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagccacagcugccuguccccaugcgggcgccaagagcuuuuauaagaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 190710 - RNA, 1701 nt, Artificial Sequence; identical to SEQ ID NO: 188290
  derived and/or modified sequence opt5 from hemagglutinin__InfluenzaA__AEO01613

SEQ ID NO: 190711 - RNA, 1701 nt, Artificial Sequence
  derived and/or modified sequence opt5 from hemagglutinin__InfluenzaA__AEO01614
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugagagagcagcuuuccagcgucucuuccuucgaacgguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacauccccagcauucagucccggggacucuuuggcgccaucgccggguucaucgagggaggcuggaccgggaugguugacggaugguacggcuaucaucaccagaaugaacaaggcucuggguacgcugcggaucuuaagagcacacagaacgccauugacgagaucaccaauaaagugaacuccgucauugagaagaugaauacgcaguuuacagcugugggaaaggaguucaaccaccuggagaaacgcaucgaaaaucugaacaagaaaguugaugacggcuuccucgauauuuggaccuacaaugccgagcugcuggugcuccuggaaaacgagagaacccuugacuaucaugauagcaaugucaagaaccuguacgagaaagugcggucucagcucaagaacaaugccaaggaaaucgggaacggauguuuugaguucuaucacaaaugcgacaauacauguauggaauccgucaagaacggcaccuacgauuauccuaaauacagcgaggaagcuaagcugaaucgcgaggagaucgacggggugaaacuugaaucuacaagaauuuaucaaauccuggccauuuacuccacgguugcgagcucccucgugcuggucgugucucugggcgcuaucagcuuuuggaugugcuccaacggaucucuccagugccggauuuguaucuga

SEQ ID NO: 190712 - RNA, 1701 nt, Artificial Sequence
  derived and/or modified sequence opt5 from hemagglutinin__InfluenzaA__AEO01615
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaaguauuacauuaaugacaaggggaaagaagugcuuguccuguggggaauccaccaccccagcaccuccgccgaucaacagucucucuaccagaacgcugacgccuauguguucgugggcacaagcagauacuccaagaaauuuaagccugagauugcuauccggccgaaaguccgcgagcaggaagggagaaugaauuauuacuggacccugguugagcccggagauaagauuacguucgaagccacaggcaaccugguggugccucgguaugcguuugccauggagcgcaacgcugggagcggaaucauuaucucugacacccccguccaugauugcaauacaaccugucaaaccccuaaaggcgccaucaacacaucccuccccuuccagaauauucacccgaucacgauuggcaagugcccuaaguacgugaaaagcaccaagcugagacuugcuacagggcugcggaacguucccucuauccagagccgcggacucuuuggcgccauugccggguucaucgaaggaggcuggaccgggaugguggacggaugguauggcuaccaucaccagaaugagcaaggcuccggguacgcugcggaccugaaaucuacacagaacgccaucgauaagauuaccaauaaagucaacagcgugaucgagaagaugaauacgcaguuuacagcuguuggaaaggaguucaaccaccuugagaaaagaauugaaaaucugaacaagaaaguggacgauggcuuccucgacaucuggaccuauaaugccgagcugcugguccuccuggaaaacgagcggacccuugauuaccaugacuccaaugugaagaaccuguaugagaaaguccgcagccagcucaagaacaaugccaaggaaauugggaacggauguuuugaguucuaccacaaaugcgauaauacauguauggaaucugugaagaacggcaccuaugacuacccuaaauauuccgaggaagcuaagcugaauagagaggagaucgaugggguuaaacuugaaagcacacggaucuaccaaauucuggccaucuacucuacgguggcguccagccucguccuggugguuucccugggcgcuauuucuuuuuggaugugcagcaacggaucccuccagugccgcaucuguauuuga

SEQ ID NO: 190713 - RNA, 1701 nt, Artificial Sequence; identical to SEQ ID NO: 186046
  derived and/or modified sequence opt5 from hemagglutinin__InfluenzaA__AEO01616

SEQ ID NO: 190714 - RNA, 1701 nt, Artificial Sequence; identical to SEQ ID NO: 186857
  derived and/or modified sequence opt5 from hemagglutinin__InfluenzaA__AEO01617

SEQ ID NO: 190715 - RNA, 1701 nt, Artificial Sequence; identical to SEQ ID NO: 187290
  derived and/or modified sequence opt5 from hemagglutinin__InfluenzaA__AEO01619

SEQ ID NO: 190716 - RNA, 1701 nt, Artificial Sequence; identical to SEQ ID NO: 190402
  derived and/or modified sequence opt5 from hemagglutinin__InfluenzaA__AEO01620

SEQ ID NO: 190717 - RNA, 1701 nt, Artificial Sequence; identical to SEQ ID NO: 190549
  derived and/or modified sequence opt5 from hemagglutinin__InfluenzaA__AEO01621

SEQ ID NO: 190718 - RNA, 1701 nt, Artificial Sequence
  derived and/or modified sequence opt5 from hemagglutinin__InfluenzaA__AEO01625
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagguccuugauggggaaaauuguacccugaucgacgcccuccugggagauccccagugcgacggcuuccaaaacaaaaagugggaucuguuuguggagagauccaaagccuauucuaauuguuacccuuaugacguucccgauuacgcuagccuccggucccugguggccagcucugggacgcuugaguucaacaaugaauccuuuaacuggaccggagucacacagaauggcaccagcucugcuugcauucgcagauccaacaauagcuucuuuucucggcugaacuggcucacacauuccaaguucaaguauccugcccugaaugugaccaugcccaacaacgaggaauuugacaaacuuuacaucuggggcguucaccauccugggacggauaaugaccagauuuuccuguaugcgcaggccagcggacgcaucacaguguccaccaagagaucucaacagacagucauuccgaacaucggcagccggccccgcgugagaaauauuccuucccggaucagcaucuacuggaccauugugaaacccggggauauccuccugauuaacucuaccggaaaucugaucgcuccucgcggcuacuuuaagauuagauccgggaaaagcucuaucaugcggagcgacgcccccaucggaaaguguaacuccgagugcauuacaccgaauggcucuaucccuaacgacaagcccuuccagaaugucaaccgcauuacguauggcgcuuguccuagauacguuaaacagaauacccucaagcuggccacagggaugcggaacgugcccgaaaaacaaacccgcggaaucuuuggcgcgauugccggguucaucgagaauggaugggagggcaugguggaugggugguauggauuuagacaccagaacagcgaaggcaucggccaggcugccgaccuuaaguccacacaagcugccauugaucagaucaaugggaaacugaaccggcucauuggaaagaccaacgagaaauuccaccagaucgaaaaggaguucagcgaagucgagggccgcauucaggaccuggagaaguacguggaagauacgaaaaucgaccuuuggucuuauaaugccgagcugcucguugcucuggaaaaccaacauacaauugaucugaccgacuccgagaugaauaagcucuuugagaaaaccaagaaacagcugagagaaaacgcggaggauauggggaauggaugcuucaagaucuaccacaagugugacaacgccugcaucggcagcauucggaaugggacauaugaucaugaaguguacagagacgaggcucuuaacaaucgcuuucagaucaaaggcgucgaacugaagucuggauacaaagacuggauucucuggaucuccuucgccauuagcugcuuucugcuuuguguggcccugcucggcuucaucaugugggcuugccagaaggggaacauccgguguaauauuugcaucuga

SEQ ID NO: 190719 - RNA, 1701 nt, Artificial Sequence
  derived and/or modified sequence opt5 from hemagglutinin__InfluenzaA__AEO01636
augaaaagcaucauugcccuguccuacauccucugccuggugucugcucagaaacuucccggcaacgacaauagcaccgccacacugugucucgggcaccaugcggucccuaacggaacgauuguuaagaccaucacaaaugaucaaauugaggugaccaacgcuacagaacuggugcaguccucuagcaccggcgagaucugcgacuccccgcaccagguccuugauggggaaaauuguacacugaucgacgcccuccugggagauccccagugcgacggcuuccaaaacaaaaagugggaucuguuuguggagagaucuaaagccuauagcaauuguuacccuuaugacguucccgauuacgcuucccuccggagccugguggccucuuccgggacccuugaauuuaacaaugagagcuucaacuggacgggagucacccagaauggcacaucuuccgcuugcauucgcagaagcaacaauucuuucuuuucccggcugaacuggcucacccauagcaaguucaaguauccugcccugaaugugacaaugcccaacaacgaggaauuugacaaacuuuacaucuggggcguucaccauccugggaccgauaaugaccagauuuuccuguaugcgcaggccuccggacgcaucacggugucuacaaagagaagccaacagaccgucauuccgaacaucggcucccggccccgcgugagaaauauuccuagccggaucucuaucuacuggacaauugugaaacccggggauauccuccugauuaacuccaccggaaaucugaucgcuccucgcggcuacuuuaagauuagaagcgggaaaucuagcaucaugcgguccgacgcccccaucggaaaguguaacucugagugcauuaccccgaauggcagcaucccuaacgacaagcccuuccagaaugucaaccgcauuacauauggcgcuuguccuagauacguuaaacagaauacgcucaagcuggccaccgggaugcggaacgugcccgaaaaacaaacacgcggaaucuuuggcgcgauugccggguucaucgagaauggaugggagggcaugguggaugggugguauggauuuagacaccagaacuccgaaggcaucggccaggcugccgaccuuaagagcacccaagcugccauugaucagaucaaugggaaacugaaccggcucauuggaaagacaaacgagaaauuccaccagaucgaaaaggaguucucugaagucgagggccgcauucaggaccuggagaaguacguggaagauaccaaaaucgaccuuugguccuauaaugccgagcugcucguugcucuggaaaaccaacauacgauugaucugacagacagcgagaugaauaagcucuuugaaaagaccaagaaacagcugagagagaacgcggaggauauggggaauggaugcuucaagaucuaccacaagugugacaacgccugcaucggcucuauucggaaugggaccuaugaucaugacguguacagagacgaagcucuuaacaaucgcuuucagaucaaaggcgucgagcugaaguccggauacaaagauuggauucucuggaucagcuucgccauuuccugcuuucugcuuuguguggcccugcucggcuucaucaugugggcuugccagaaggggaacauccgguguaauauuugcaucuga

SEQ ID NO: 190720 - RNA, 1701 nt, Artificial Sequence
  derived and/or modified sequence opt5 from hemagglutinin__InfluenzaA__AEO01642
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcaauagcccgcaccagauccuugacggggaaaacuguacccugauugaugcccuccugggagacccccagugcgauggcuuccaaaauaaaaagugggaccuguuugucgagagauccaaagccuauucuaacuguuacccuuaugaugugcccgacuacgcuagccuccggucccugguugccagcucugggacgcuugaguucaauaacgaauccuuuaauuggaccggagugacacagaacggcaccagcucugcuugcauccgcagauccaauaacagcuucuuuucucggcugaauuggcucacacaucugaaguucaaguauccugcccuuaacgucaccaugcccaacaaugaggaauuugauaaacuguacauuuggggcgugcaccauccugggacggacaacgaucagaucuuccucuaugcgcaggccuccggacgcauuacaguuagcaccaagagaucccaacagacagugaucccgaauauuggcucucggccccgcgucagaaacaucccuagccggaucuccauuuacuggaccaucgugaaacccggggacauucugcugaucaauagcaccggaaaccucauugcuccucgcggcuacuuuaagaucagaucugggaaauccagcaucaugcggucugaugcccccauuggaaaguguaauagcaagugcaucacaccgaacggcuccauuccuaaugacaaacccuuccagaacgugaaucgcgucacguauggcgcuuguccuagauacguuaagcagaacacccugaaacuugccacagggaugcggaaugugcccgagaagcaaacccgcggaaucuuuggcgcgauugccggguucaucgaaaacggaugggagggcaugguggacgggugguauggauuuagacaccaaaauucugagggcaucggccaggcugccgaucugaaaagcacacaggcugccauugaccagaucaacgggaagcucaaccggcugauuggaaaaaccaaugaaaaguuccaccagaucgagaaggaguucuccgaagucgaaggccgcauucaggaucuugagaaauacguggaggacacgaagaucgaucuguggagcuauaacgccgaacuccugguugcucuggagaaucaacauacaauugaccucaccgauucugaaaugaacaaacuguuugagaagaccaaaaagcagcuuagagaaaaugcggaggacauggggaacggaugcuucaagaucuaccacaaaugugauaaugccugcaucggcuccauucggaacgggacauaugaccaugauguguacagagacgaggcucugaauaaccgcuuucagaucaagggcgucgaacucaaaagcggauacaaggacuggauucuguggaucucuuucgccauuuccugcuuucuucuguguguggcccuccugggcuucaucaugugggcuugccagaaagggaauauccgguguaacauuugcaucuga

SEQ ID NO: 190721 - RNA, 1698 nt, Artificial Sequence
  derived and/or modified sequence opt5 from hemagglutinin__InfluenzaA__AEO01663
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccggcaaaaaugggcucuaccccaaccugucuaaguccuaugccaauaacaaagagaaggaagugcugguccucuggggagugcaccacccuccgaacaucggcgaccagaaagcucuguaccauacagagaaugccuacgugagcgucguuuccucucacuauagcagaaaguucacccccgaaauugcgaagcggccuaaagugcgcgaucaggaggggagaaucaacuacuauuggacacuucuggagcccggagacaccauuaucuuugaagccaauggcaaccuccgggcuccucgcuacgccuucgcucuguccagaggguuuggaagcggcauuaucaauucuaacgcccccauggauaagugugacgcgaaaugccagacgccgcaaggcgccauuaauuccagccuuccuuuccagaacgugcaucccgucccuaucggggagugucccaaguaugugcggucugcuaaacugcgcaugguuacaggacucagaaauauccccagcauucagucccggggccuguuuggggccaucgcuggauucauugaaggcggguggaccggaaugguggauggcugguacggcuaucaccaccagaacgagcaagggucuggauacgccgccgaccaaaagagcacacagaaugcuaucaacggcauuaccaauaaagucaacuccgugaucgaaaagaugaauacccaguuuacagcgguugggaaggaguucaacaaacuggagcgcagaauggaaaaccucaauaagaaaguggaugacggauucaucgauauuuggacguacaacgccgagcugcuuguccugcucgaaaaugagcggacccuggacuuucaugacagcaacgugaagaaucuuuaugaaaaagucaagucucagcugaagaacaaugcuaaagagaucggcaacgggugcuucgaguuuuaccacaaguguaaugaugaaugcauggaguccgugaaaaacggcacauaugacuacccuaaguauagcgaagagucuaaacucaaucgcgagaagauugauggaguuagacuggaauccaugggcguguaccagauccuggccauuuauagcaccgucgccuccucucucgugcugcuuguuagccugggggcuaucuccuucuggaugugcucuaacggaagccuccagugucggaucugcauuuga

SEQ ID NO: 190722 - RNA, 1698 nt, Artificial Sequence
  derived and/or modified sequence opt5 from hemagglutinin__InfluenzaA__AEO01674
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaaugagaaccucaaggccccucgguacgcuuucgcccugucccgcggcuuugggagcggaauuaucaauucuaaagcucccauggauaagugugacgccaaaugccagacaccgcaaggcgcgauuaacuccagccuuccuuuccagaaugugcaucccgucaccaucggcgaauguccuaaguaugugagaucugccaaacugcggaugguuacagggcuccgcaacauccccagcauucaguccagaggacuguuuggcgcuaucgccggguucauugagggaggcuggaccgggaugguggauggaugguacggcuaucaccaccagaaugaacaaggcucuggguacgcugccgaccagaaaagcacccagaacgccaucaauggaauuacaaacaaggucaauuccgugaucgagaaaaugaacacgcaguuuaccgcuguuggcaaggaguucaauaaacuggaacggcgcauggagaaccucaacaagaaaguggaugacggguucaucgauauuuggacauacaaugcggaacugcuuguccugcucgagaacgaaagaacccuggacuuucaugacagcaaugugaagaaccuuuaugagaaggucaaaucucaacugaagaauaacgccaaagagaucggaaauggcugcuucgaauuuuaccacaaguguaacgaugagugcauggaauccgugaaaaaugggacauaugacuaccccaaguauagcgaggagucuaagcucaaccgggaaaagauugauggcguucgccuggaguccaugggaguguaccagauccuggcuauuuauagcaccgucgccuccucucucgugcugcuuguuagccugggcgccaucuccuucuggaugugcucuaaugggagccuccaguguagaaucugcauuuga

SEQ ID NO: 190723 - RNA, 1701 nt, Artificial Sequence; identical to SEQ ID NO: 190718
  derived and/or modified sequence opt5 from hemagglutinin__InfluenzaA__AEO01691

SEQ ID NO: 190724 - RNA, 1698 nt, Artificial Sequence
  derived and/or modified sequence opt5 from hemagglutinin__InfluenzaA__AEO01699
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagccccgggacacgauuaucuuugaagcgaauggaaaccucauugccccucgcuacgcuuucgcccuguccagaggcuuugggagcggaaucauuaauucuaacgcucccauggauaagugugacgccaaaugccagacaccgcaaggcgcgaucaauuccagccuuccuuuccagaacgugcaucccgucaccaucggcgaguguccuaaguaugugcggucugccaaacugcgcaugguuacagggcucagaaauauucccagcauccccucccggggacuguuuggcgcuauugccggguucaucgaaggaggcuggaccgggaugguggauggaugguacggcuaucaccaccagaacgagcagggcucuggguacgcugccgaccaaaagagcacccagaaugccauuaacggaaucacaaauaaagucaacuccgugaucgaaaagaugaauacgcaguuuaccgcuguuggcaaggaguucaacaaacuggagcgcagaauggaaaaccucaauaagaaaguggaugacggguucauugauaucuggacauacaacgcggagcugcuuguccugcucgaaaaugagcggacccuggacuuucaugacagcaacgugaagaaucuuuaugaaaaagucaagucucagcugaagaacaaugccaaagagauuggaaacggcugcuucgaguuuuaccacaaguguaaugaugaaugcauggaguccgugaaaaacgggacauaugacuacccuaaguauagcgaagagucuaaacucaaucgcgagaagaucgauggcguuaagcuggaauccaugggagcuuaccaaauucuggccaucuauagcaccggcgccuccucucucgugcugcuugucagccugggggcuaucuccuucuggaugugcucuaacggaagccuccagagacggauuuguaucuga

SEQ ID NO: 190725 - RNA, 1698 nt, Artificial Sequence
  derived and/or modified sequence opt5 from hemagglutinin__InfluenzaA__AEO01709
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaacuucgcgaucaggacgggagaaucaacuacuauuggacccugcucgagcccggagauacgacaauuuuugaggcgaauggcaaccugaucgccccucgguacgcuuucgcccuuucccgcggguuuggaagcggcauuaucaauucuaacgcucccauggacaagugugaugccaaaugccagaccccgcaaggcgcgauuaauuccagccugccuuuccagaacgugcaucccgugacaaucggggaauguccuaaguaugucagaucugccaaacuccggauggugaccggacugcgcaauauccccagcauucaguccagaggccuguuuggggcuaucgccggauucauugagggcggguggaccggaaugguugacggcugguacggcuaucaccaccagaacgaacaagggucuggauacgcugccgaucaaaagagcacacagaaugccaucaacggcauuacgaauaaagugaacuccgucaucgagaagaugaauacccaguuuacagcuguggggaaggaguucaacaaacucgaacggcgcauggagaaccugaauaagaaaguugacgauggauucaucgacauuuggaccuacaacgcggaacuucuggugcuccuggagaaugaaagaacacuugacuuucaugauagcaacgucaagaaucuguaugagaaagugaagucucagcucaagaacaaugccaaagaaaucggcaacgggugcuucgagcuguaccugaaguguaauggcgagugcauggaauccgucaaaaacggaaccuaugacuaccccaaguauagcgaggaaucuaaacucaaucgggagaagauugauggcgugaagcuggaguccauggggguuuaccagauccuugcuauuuauagcacgguggccuccucucugguccuccuggugagccugggagccaucuccuuuuggaugugcucuaacggcagccuucagugucgcaucugcauuuga

SEQ ID NO: 190726 - RNA, 1701 nt, Artificial Sequence; identical to SEQ ID NO: 186857
  derived and/or modified sequence opt5 from hemagglutinin__InfluenzaA__AEO37530

SEQ ID NO: 190727 - RNA, 1701 nt, Artificial Sequence
  derived and/or modified sequence opt5 from hemagglutinin__InfluenzaA__AEO72176
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagauugggaauggauguuuugaguucuaucacaaaugcgacaacacauguauggaaagcgugaagaauggcacguacgauuauccuaaauacucugaagaggccaagcugaacagagaagagaucgacgggguuaaacuugaguccacccggaucuaucaaauucuggcuaucuacagcacaguggccucuucccucguccuggcggugagccugggcgcuauuuccuuuuggaugugcucuaauggaagccuccagugccgcaucuguauuuga

SEQ ID NO: 190728 - RNA, 1704 nt, Artificial Sequence
  derived and/or modified sequence opt5 from hemagglutinin__InfluenzaA__AEO88980
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaauccgggagaauggacuuuuucuggaccauucugaagccuaacgaugcgaucaauuuugaaagcaacggaaauuucauugcccccgaguacgcuuauaaaaucgucaagaaaggcgacuccgccaucaugaagucugaaguugaguacgggaacugcaauacgaaaugucagacaccuauuggagcuaucaacagcuccaugcccuuucauaauauucacccgcucaccaucggcgaaugcccuaaguaugugaaaagcaacaaacuggugcuugccacagggcugcgcaauucuccccuccgggagagacggcgcaagagaggacuguucggcgcgauugccggcuuuaucgaagggggauggcagggcauggucgacgggugguacggauaucaucacuccaacgaacagggcagcggguacgcugccgauaaagagucuacccaaaaggcuaucgacggagugaccaauaaaguuaacagcauuaucgauaagaugaacacacaguucgaagccgugggccgggaguuuaauaaccuugaacgcagaauugagaaucugaacaagaaaauggaggacggcuuccucgaugucuggacguauaaugccgaacugcuggugcucauggagaacgaacggacccuggacuuccacgauuccaauguuaagaaccuuuacgacaaagugcgccugcagcucagagauaaugcuaaggagcuggggaacggauguuuugaguucuaccauaaaugcgacaaugaguguauggagucuguccggaacggcacauaugauuacccucaauauagcgaagaggcgagacuuaagcgcgaagagaucuccggggugaagcuggagagcauuggaaccuaccagauccucucuauuuauuccacagucgccagcucucuggcucuggccaucaugguggccggccucucccuguggaugugcagcaaugggucccuucagugccggaucuguauuuga

SEQ ID NO: 190729 - RNA, 1704 nt, Artificial Sequence
  derived and/or modified sequence opt5 from hemagglutinin__InfluenzaA__AEO89021
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucccaucauuccuaagagcuccuggucugaucaugaagccagcuccggcgugagcucugcuugucccuaccaggggaccccuuccuuuuuccgcaauguuguguggcugaucaaaaagaacaauacauauccgaccauuaaaagaagcuacaacaauacaaaccaggaggaccuccugauccuuuggggaauccaccacucuaacaaugccgcugagcaaaccaagcuguaucagaaccccacgaccuacauuuccgucggcacaagcacccucaaucugcggcuggugccuaagaucgccacacgcucuaaagugaacggccaguccgggagaauggauuucuucuggaccauucucaagcccaaugacgcgaucaacuuugaaagcaauggaaacuucauugccccugaguacgcuuauaaaaucgucaagaaaggcgauuccgccaucaugaagucugaaguugaguacgggaauugcaacacgaaaugucagacacccauuggagcuaucaauagcuccaugccguuucauaacauucacccucugaccaucggcgaaugccccaaguaugucaagagcaauaaacuugugcuggccacagggcuccggaacucuccucugcgcgagagacggcgcaagagaggacuuuucggcgcgauugccggcuuuaucgaagggggauggcaaggcaugguggacgggugguacggauaucaucacuccaaugaacagggcagcggguacgcugccgacaaagagucuacccagaaggcuaucgauggagugaccaacaaaguuaacagcauuaucgacaagaugaauacacaguucgaagccgugggccgggaguuuaacaaucuggaacgcagaauugagaaccucaauaagaaaauggaggauggcuuccuggacgucuggacguauaacgccgaacugcucgugcugauggagaaugaacggacccuugauuuccacgacuccaacguuaagaaucuguacgauaaagugcgccuccaacugagagacaacgcuaaggagcuugggaauggauguuuugaauuuuaccauaaaugcgauaacgaguguauggagucuguccggaauggcacauaugacuacccccaguauagcgaagaggcgagacugaagcgcgaagagaucuccggggugaagcucgagagcauuggaaccuaccagauccugucuauuuauuccacagucgccagcucucuggcucucgccaucaugguggccggccugucccuuuggaugugcagcaacgggucccugcaaugccggaucuguauuuga

SEQ ID NO: 190730 - RNA, 1704 nt, Artificial Sequence
  derived and/or modified sequence opt5 from hemagglutinin__InfluenzaA__AEO89030
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucuguuuguccuuaccaggggacccccuccuuuuuccgcaauguggucuggcugaucaaaaagaacaauacauauccuaccauuaaaagaagcuacaacaauacaaaccaagaggaccuccugauccuuuggggaauccaccacucuaacgaugcugccgagcagaccaagcuguaucagaauccgacgaccuacauuuccgugggcacaagcacccucaaccagcggcuggugcccaagaucgcuacacgcucuaaagucaauggccaauccgggagaauggacuuuuucuggaccguucugaagccuaacgaugccauuaauuuugaaagcaacggaaauuucaucgcgcccgaguacgccuauaaaauugugaagaaaggcgacuccgcuaucaugaagucugaaguggaguacgggaacugcaauacgaaaugucagacaccuaucggagccauuaacagcuccaugcccuuucauaauauccacccgcucaccauuggcgaaugcccuaaguaugucaagagcaacaaacuggugcuugcuacagggcugcgcaauucuccccuccgggagagacggcgcaagagaggacuguucggcgccaucgcgggcuuuauugaagggggauggcagggcaugguugacgggugguacggauaucaucacuccaacgaacagggcagcggguacgccgcugauaaagagucuacccaaaaggccaucgacggagugaccaauaaagucaacagcaucauugauaagaugaacacacaguucgaagcugugggccgggaguuuaauaaccuugaacgcagaaucgagaaucugaacaagaaaauggaggacggcuuccucgauguuuggacguauaaugccgaacugcuggugcucauggagaacgaacggacccuggacuuccacgauuccaaugucaagaaccuuuacgacaaagugcgccugcagcucagagauaaugccaaggagcuggggaacggauguuuugaguucuaccauaaaugcgacaaugaauguauggagucuguccggaacggcacauaugauuacccucaauauagcgaagaggcuagacuuaagcgcgaagagauuuccggggugaagcuggagagcaucggaaccuaccagauucucucuaucuauuccacaguugcgagcucucuggcccuggcuauuaugguggccggccucucccuguggaugugcagcaaugggucccuucagugccggaucuguaucuga

SEQ ID NO: 190731 - RNA, 1704 nt, Artificial Sequence
  derived and/or modified sequence opt5 from hemagglutinin__InfluenzaA__AEO89048
auggagaagaucguguuccugcucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgccaaugaucugugcuacccuggaaacuucaaugacuaugaggaacugaagcaucuccugucucggaucaaccacuuugagaaaauucagaucauucccaagagcuccuggucugaucaugaagccagcuccggcgugagcucugcuuguccuuaccaggggacccccuccuucuuucgcaauguuaucuggcuuauuaaaaagaacaauacauauccuaccaucaaaagaagcuacaacaauacaaaccaagaggaccugcucauccugugggggauucaccacucuaacgaugccgcugagcagaccaaacuuuaucagaauccgacgaccuacaucuccgugggcacaagcacccugaaccagcggcucguccccaagauugccacacgcucuaaagugaauggccaauccgggagaauggacuucuuuuggaccauccugaagccuaacgaugcgauuaauuucgaaagcaacggaaauuuuaucgcccccgaguacgcuuauaaaaucgugaagaaaggcgacuccgccauucugaagucugaagucgaguacgggaacugcaauacgaaaugucagacaccuaucggagcuauuaacagcuccaugcccuuccauaauauccacccgcucaccauuggcgaaugcccuaaguauguuaagagcaacaaacuggugcuugccacagggcugcgcaauucuccccuccgggagagacggcgcaagagaggacuguuuggcgcgaucgccggcuucaucgagggaggauggcagggcaugguggacgggugguacggauaucaucacuccaacgaacagggcagcggguacgcugccgauaaagagucuacccaaaaggcuauugacggagucaccaauaaagugaacagcaucauugauaagaugaacacacaguuugaagccguuggccgggaguucaauaaccuugaacgcagaaucgagaaucugaacaagaaaauggaggacggcuuccucgauguguggacguauaaugccgaacugcugguccucauggagaacgaacggacccuggacuuucacgauuccaaugugaagaaccuuuacgacaaaguucgccugcagcucagagauaaugcuaaggagcuggggaacggauguuucgaauuuuaccauaaaugcgacaaugaguguauggagucugugcggaacggcacauaugauuacccucaauauagcgaagaggcgagacuuaagcgcgaagagauuuccggggucaagcuggagagcaucggaaccuaccagauucucucuaucuauuccacaguggccagcucucuggcucuggccaucauggucgccggccucucccuguggaugugcagcaaugggucccuucagugccggauuuguaucuga

SEQ ID NO: 190732 - RNA, 1704 nt, Artificial Sequence
  derived and/or modified sequence opt5 from hemagglutinin__InfluenzaA__AEO89065
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucuguuuguccuuaccaggggacccccuccuuuuuccgcaauguggucuggcugaucaaaaagaacaauacauauccuaccauuaaaagaagcuacaacaauacaaaccaagaggaccuccugauccuuuggggaauccaccacucuaacgaugcugccgagcagaccaagcuguaucagaauccgacgaccuacauuuccgugggcacaagcacccucaaccugcggcuggugcccaagaucgcuacacgcucuaaagucaauggccaguccgggagaauggacuuuuucuggaccauucucaagccuagcgaugccaucaacuuugaauccaauggaaacuucauugcgcccgaguacgccuauaaaaucguuaagaaaggcgacucugcuaucaugaaaagcgaaguggaguacgggaauugcaacacgaaaugucaaacaccuauuggagccaucaauuccagcaugcccuuucauaacauucacccgcugaccaucggcgaaugcccuaaguaugugaagucuaauaaacuuguccuggcuacagggcuccggaacagcccccugcgcgagagacggcgcaagagaggacuuuucggcgccauugcgggcuuuaucgaagggggauggcagggcaugguggacgggugguacggauaucaucacuccaaugaacagggcucuggguacgccgcugauaaagagagcacccagaaggccaucgacggaguuaccaacaaagucaauuccauuaucgauaagaugaacacacaauucgaagcugugggccgggaguuuaacaaucuggaacgcagaauugagaaccucaauaagaaaauggaggacggcuuccuggauguguggacguauaacgccgaacugcucguucugauggagaaugaacggacccuugacuuccacgauucuaacgugaagaaucuguacgacaaaguccgccuccagcugagagauaacgccaaggagcuugggaauggauguuuugaguucuaccauaaaugcgacaacgaguguauggagagcgugcggaauggcacauaugauuacccucaguauuccgaagaggcuagacugaagcgcgaagagaucagcggggucaagcucgagucuauuggaaccuaccaaauccuguccauuuauagcacaguggcgucuucccuggcccucgcuaucaugguugccggccugagccuuuggaugugcuccaacgggucucugcagugccggaucuguauuuga

SEQ ID NO: 190733 - RNA, 1704 nt, Artificial Sequence
  derived and/or modified sequence opt5 from hemagglutinin__InfluenzaA__AEO89082
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugacaccagcuccggcgugagcucugccuguccuuaccaggggacacccuccuuuuuccgcaauguuguguggcugaucaaaaagaacaauaccuauccuacaauuaaaagaagcuacaacaauaccaacaaggaagaucuccugauccuuuggggaauccaccacucuaacgacgcugccgagcaaacgaagcuguaucagaauccgaccacauacauuuccgucggcaccagcacacucaaccagcggcuggugcccaaaaucgcuacccgcucuaaggugaauggccaguccgggagaauggacuuuuucuggacgauucugaaaccuaacgaugccaucaauuuugagagcaacggaaauuucauugcgcccgaauacgccuauaagaucgucaaaaagggcgacuccgcuaucaugaaaucugagguugaauacgggaacugcaauacaaagugucaaaccccuauuggagccaucaacagcuccaugcccuuucauaauauucacccgcucacaaucggcgagugcccuaaguaugugaaaagcaacaagcuggugcuugcuaccgggcugcgcaauucuccccuccgggaaagacggcgcaaaagaggacuguucggcgccauugcgggcuuuaucgaagggggauggcagggcauggucgaugggugguacggauaucaucacuccaacgagcagggcagcggguacgccgcugacaaggaaucuacccagaaagccaucgauggagugacaaauaagguuaacagcauuaucgacaagaugaacacgcaauucgaggcugugggccgggaauuuaauaaccuugagcgcagaauugaaaaucugaacaaaaagauggaggauggcuuccucgacgucuggaccuauaaugccgagcugcuggugcucauggaaaacgagcggacacuggauuuccacgacuccaauguuaaaaaccuuuacgauaaggugcgccugcagcucagagacaaugccaaagaacuggggaacggauguuuugaguucuaccauaagugcgauaaugaauguauggagucuguccggaacggcaccuaugacuacccucaguauagcgaggaagcuagacuuaagcgcgaggaaaucuccggggugaaacuggagagcauuggaacauaccaaauccucucuauuuauuccaccgucgcgagcucucuggcccuggcuaucaugguggccggccucucccuguggaugugcagcaaugggucccuucagugccggaucuguauuuga

SEQ ID NO: 190734 - RNA, 1704 nt, Artificial Sequence
  derived and/or modified sequence opt5 from hemagglutinin__InfluenzaA__AEO89091
auggagaagaccguguuccugcucgccaucgucagccugguuaaauccgaccagauuugcaucggcuaccacgcuaacaauucuacagaacaaguggauacgauuauggagaagaacgugaccgucacacaugcccagaauauccuugagaaaacccacaacgggaagcugugugacauugauggagugaaaccccucauccugaaggacugcagcguugcgggcuggcuucuggggaauccuaugugugaugaauuuaucaacgugccggaaugguccuauauugucgagaaggcuaaucccgccaacgaccucugcuacccuggaaauuucaacgauuaugaggaacugaaacaucugcucucuagaaucaaucacuuugagaagauucagaucauucccaaaagcuccuggucugaccaugaagccagcuccggcgugagcucuacauguccuuaccaggggacccccuccuucuuucggaacguuguguggcugaucaagaaaaauaacacauauccuaccauuaagcgcagcuacaauaacacgaaccaagaggaucuucugauccucuggggaauccaccacucuaaugacgaggcugaacaggccaagcuguaucagaacccgaccacauacauuuccgucggcaccagcacacuuaaucagagacuggugcccaaaaucgcuacccggucuaaggugaacggccaauccgggcgcauggauuucuuuuggacgauucucaaaccuaaugacgccaucaacuucgagagcaauggaaacuuuauugcgcccgaauacgccuauaagaucgucaaaaagggcgauuccgcuaucaugaaaucugagguugaauacgggaauugcaacacaaagugucagaccccuauuggagccaucaauagcuccaugcccuuccauaacauucacccgcugacaaucggcgagugcccuaaguaugugaaaagcaauaagcuggugcucgcuaccgggcugagaaacucuccccuucgggagcgcagacggaaacgcggacuguuuggcgccauugcgggcuucaucgaagggggauggcagggcauggucgacgggugguacggauaucaucacuccaaugagcagggcagcggguacgccgcugacaaggaaucuacccaaaaagccaucgauggagugacaaacaagguuaacagcauuaucgacaagaugaauacgcaguuugaggcugugggcagagaguucaacaaucucgaacggcgcauugagaaccugaauaaaaagauggaagauggcuuccuugacgucuggaccuauaacgccgagcugcucgugcugauggaaaaugagagaacacuggauuuucacgacuccaacguuaaaaaucucuacgauaaggugcggcugcagcuucgcgacaacgccaaagaacuggggaauggauguuucgaguuuuaccauaagugcgaugacgaguguauggaaucugucagaaacggcaccuaugauuacccucaauauagcgaggaagcucggcucaagagagaggagaucuccggggugaaacuggaaagcauuggaacauaccagauccuuucuauuuauuccaccgucgcgagcucucuggcccucgcuaucaugauggccggccugucccuguggaugugcagcaaugggucccuccagugccgcaucuguauuuga

SEQ ID NO: 190735 - RNA, 1704 nt, Artificial Sequence
  derived and/or modified sequence opt5 from hemagglutinin__InfluenzaA__AEO89100
auggagaagaucgugcccuuccuggccauuaucagccucgucaaauccgaccagauuugcaucggcuaccacgcuaacaauucuaccgaacaaguugauacaauuauggagaagaacgugacggugacccaugcccaggacauccuggaaaagacacacaaugggaaacuuugugaucuggacggagucaaaccucucauccugagagauugcagcguggcgggcuggcuucuggggaacccgaugugugacgaguuuauuaauguucccgaaugguccuauaucguggagaaggcuaacccugccaaugaucucugcuaccccggaaacuucaaugacuaugaggaacugaagcaucugcucucucggauuaaccacuuugagaaaauccagauuaucccuaagaauagcugguccgaucaugaagccucuagcggcgucuccagcgcuugucccuaccaggggaccccuucuuucuuucgcaacgugguuuggcugauuaaaaagaauaacacauauccgaccaucaaaagauccuacaauaacacaaaccaagaggaccuucugauccucuggggcauucaccacagcaaugaugccgcugagcagaccaagcuguaucagaaccccacgaccuacaucucugugggaacauccacccuuaaucagcggcuggucccuaagauugccacacgcagcaaagugaacggccaaucugggagaauggacuucuuuuggaccauccucaagcccaaugaugcgauuaacuucgaauccaauggaaacuuuaucgccccugaguacgcuuauaaaaucgugaagaaaggcgacagcgccauuaugaaguccgaagucgaguacgggaauugcaacacgaaaugucagacacccaucggagcuauuaauucuagcaugccguuccauaacauccacccucugaccauuggcgaaugccccaaguauguuaaguccaauaaacuggugcucgccacagggcugcggaacagcccucuucgcgagagacggcgcaagagaggacuguuuggcgcgaucgccggcuucaucgaagggggauggcagggcaugguggacgggugguacggauuucaucacucuaaugaacagggcuccggguaugcugccgauaaagagagcacccaaaaggcuauugacggagucaccaacaaagugaacucuaucauugauaagaugaauacacaguucgaagccguuggccgggaguucaacaaucucgaacgcagaaucgagaaccugaauaagaaaauggaggacggcuuucuugauguguggacguacaacgccgaacugcucguccugauggagaaugaacggacccuggacuuccacgauagcaacgugaagaaucucuaugacaaaguucgccugcagcuuagagauaacgcuaaggagcuggggaauggauguuuugaguucuaccauaaaugcgacgaugaguguauggaguccgugaagaacggcacauacgacuauccccaauacucugaagaggcgcggcucaagagagaagagauuagcggggucaaacuggaguccaucggaaccuaucagauucuuagcaucuacucuacaguggccuccagccuggcucucgccaucauggucgccggccugucucuguggaugugcuccaaugggagccuccagugccgcauuuguaucuga

SEQ ID NO: 190736 - RNA, 1704 nt, Artificial Sequence
  derived and/or modified sequence opt5 from hemagglutinin__InfluenzaA__AEO89109
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccgcugagcagauuaagcuguaucagaacccgaccacguacaucuccgucggcaccagcacacucaaucagcggcuggugaccaagauugccacacgccccaaagugaacggccaaucugggagaauggacuuuuucuggaccauccugaagccuaaugaugcgauuaacuuugaauccaauggaaacuucaucgcccccgaguacgcuuauaaaaucgucaaggaaggcgauagcgccauuaugaaauccgagguugaauacgggaauugcaacacgaagugucagacaccuaucggagcuauuaauucuagcaugcccuuucauaacauccacccgcucaccauuggcgagugcccuaaauaugugaaguccaauaagcuggugcuugccacagggcugcggaacagcccccuccgcgagagacggcgcaaaagaggacuguucggcgcgaucgccggcuuuaucgaagggggauggcagggcauggucgacgggugguacggauaucaucacucuaaugagcagggcuccggguacgcugccgacaaggaaagcacccaaaaagcuauugauggagugaccaacaagguuaacucuaucauugacaaaaugaauacacaguucgaggccgugggccgggaauuuaacaaucuugagcgcagaaucgagaaccugaauaagaagauggaagauggcuuccucgacgucuggacguauaacgccgagcugcuggugcucauggaaaaugagcggacccuggauuuccacgacagcaacguuaaaaaucuuuacgauaaggugcgccugcagcucagagacaacgcuaaagaacuggggaauggauguuuugaguucuaccauaagugcgauaacgaguguauggaauccguccggaauggcacauaugacuacccucaauauucugaggaagcgagacuuaaacgcgaggagauuagcggggugaagcuggaauccaucggaaccuaccagauucucagcaucuauucuacagucgccuccagccuggcucuggccaucaugguggccggccucucucuguggaugugcuccaacgggagccuucagugccggauuuguaucuga

SEQ ID NO: 190737 - RNA, 1704 nt, Artificial Sequence
  derived and/or modified sequence opt5 from hemagglutinin__InfluenzaA__AEO89127
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggaaaagacacacaaugggaaacucugugaucuggacggagucaaaccccuuauccugagagauugcagcguggcgggcuggcuccuggggaacccuaugugugacgaguucauuaauguuccggaaugguccuauaucguggagaaggcuaaccccgccaaugaucugugcuacccuggaaacuuuaaugacuaugaggaacucaagcaucugcuuucucggauuaaccacuucgagaaaauccagauuauccccaagagcuccuggucugaucaugaagccagcuccggcgucagcucugcuuguccuuaccaggggacccccuccuuuuuccgcaaugugguuuggcugauuaaaaagaacaauacauauccuaccaucaaaagaagcuacaacaauacaaaccaagagaaccuccugauccuuuggggcauucaccacucuaaugacgccgcugagcagaucaagcuguaucagaacccgaccacguacauuuccgugggaaccagcacacucaaucagcggcugguccccaagaucgccacccgcucuaaagugaacggccaauccgggagaauggacuuuuucuggacaauucugaagccuaaugaugcgaucaacuuugaaagcaauggaaacuucaucgcccccgaguacgcuuauaaaauugugaaggaaggcgauuccgccaucaugaaaucugaggucgaauacgggaauugcaacaccaagugucagacgccuauuggagcuaucaauagcuccaugcccuuucauaacauucacccgcucacaaucggcgagugcccuaaauauguuaagagcaauaagcuggugcuugccaccgggcugcggaacucuccccuccgcgagagacggcgcagacggggacuguucggcgcgaucgccggcuuuauugaagggggauggcagggcaugguggacgggugguacggauaucaucacuccaaugagcagggcagcggguacgcugccgacaaagaaucuacacaaaaggcuaucgauggagucaccaacaaagugaacagcauuaucgacaagaugaauacccaguucgaggccguuggccgcgaauuuaacaaucuugagagacggauugagaaccugaauaaaaagauggaagauggcuuccucgacguguggacauauaacgccgagcugcugguccucauggaaaaugagcgcacgcuggauuuccacgacuccaacgugaagaaucuuuacgauaaaguuagacugcagcuccgggacaacgcuaaggaacuggggaauggauguuuugaguucuaccauaaaugcgauaacgaguguauggaaucugugagaaauggcaccuaugacuacccucaauauagcgaggaagcgcgccuuaagcgggaggagaucuccgggauuaaacuggaaagcaugggaacauaccagauccucucuaucuauuccaccgucgccagcucucuggcucuggccauuaugguggccggccucucccuguggaugugcagcaacgggucccuucagugcagaaucuguauuuga

SEQ ID NO: 190738 - RNA, 1704 nt, Artificial Sequence
  derived and/or modified sequence opt5 from hemagglutinin__InfluenzaA__AEO89145
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugggcgauugcagcguugcgggguggcuccugggaaacccuaugugugacaaguucaucaaugugccggaaugguccuauauugucgaaaaggcuaaccccgccaaugaucugugcuacccuggcaacuuuaaugacuaugaggagcucaaacaucugcuuucuagaaucaaccacuucgaaaagauucagaucauucccaaaagcuccuggucugaucaugaggccagcuccggggugagcucugcuuguccuuaccagggaacccccuccuuuuuccggaauguuguguggcugacaaagaaaaacaauaccuauccuacaaucaagcgcagcuacaacaauaccaaccaagaagaccuccugauucuuuggggcauccaccacucuaacaaugccgcugagcaggagaagcuguaucagaacccgacgaccuacaucuccgucggcacaagcacccucaaucagagacuggugcccaaaauugccacacggucuaaggugaacgggcaauccggacgcauggacuuuuucuggaccauccugaaaccuaaugaugcgauuaacuuugaaagcaauggcaacuucaucgcccccgaguacgcuuauaagauugucaaaaagggggauuccgccaucaugaaaucuggaguugaauacggcaauugcaacacgaagugucagacaccuaucggggcuauuaauagcuccaugcccuuucauaacauccacccgcucaccauuggagagugcccuaaguaugugaaaagcaauaagcuggugcuugccacaggccugagaaacucuccccuccgggaacgcagacggaaacgcggccuguucggggcgaucgccggauuuauugagggcggguggcagggaauggucgacggcugguacggguaucaucacuccaaugagcagggaagcggcuacgcugccgacaaggaaucuacccaaaaagcuaucgauggcgugaccaacaagguuaacagcaucauugacaagaugaauacacaguucgaggccguggggagagaauuuaacaaucuugagcggcgcaucgaaaaccugaauaaaaagauggaggauggauuccucgacgucuggacguauaacgccgagcugcuggugcucauggaaaaugagagaacccuggauuuccacgacuccaacguuaaaaaucuuuacgauaaggugcggcugcagcuccgcgacaacgcuaaagaacugggcaauggguguuuugaguucuaccauaagugcgauaacgaauguauggagucugucagaaauggaacauaugacuacccucaauauagcgaggaagcgcggcuuaagagagaggaaauuuccggcgugaaacuggagagcaucgggaccuaccagauucucucuaucuauuccacagccgcuagcucucuggcccuggccauuauggucgcuggccucucccuguggaugugcagcaacggaucccuucagugccgcaucuguaucuga

SEQ ID NO: 190739 - RNA, 1707 nt, Artificial Sequence
  derived and/or modified sequence opt5 from hemagglutinin__InfluenzaA__AEO89163
auggagaagaucgugcuccuguucgccauugucagccugguuaaauccgaccacaucugcauuggcuaccaugcuaacaauucuaccgaacagguggauacaaucauggagaagaacgugacggucacccacgcccaagacauucuugaaaagacacauaaugggaagcugugugaucucaacggagugaaaccccugauccuuaaggacugcagcguugcgggcuggcugcucgggaauccuaugugugaugaguuuaucgacgugccggaaugguccuauauugucgagaaggcuaaccccgccaaugaucugugcuacccuggaaacuucaaugacuaugaggaacugaaacaccuccugucuagaaucaaccauuuugagaagauucagaucauucccaaagauagcuggccugaccacgaagccucccuuggcgugucuagcgcuugucccuaccagggaaauuccagcuucuuucggaacguuguguggcugaucaagaaagggaaugccuauccuaccauuaagaagucuuacaacaauacaaacaaagaggaucuccugauccuuuggggcauccaccauccgaacgacgaggcugaacagacccgccuguaucaaaaucccacaaccuacauuuccaucggcacgagcacccucaaccagagacuggucccucggauugccacacgcucuaaggugaaugggcaguccggaagaaucgauuucuuuuggaccauucugaaacccaacgacgcgaucaauuucgagagcaacggcaauuuuaucgccccugaauacgcuuauaagauugugaaaaagggggacucuacaaucaugaaauccgaggucgaauacggaaacugcaauacccggugucagacgcccaugggcgccauuaacagcuccaugccguuccacaauauccauccucucacaauuggggagugccccaaguauguuaagucuaacaaacuggugcuugcuaccggacugcgcaauagcccucaaagagagcggcgcagacggaagcgcggccucuuuggcgccaucgcgggguucaucgaaggaggcuggcaggggaugguggauggaugguacggcuaucaccacuccaacgagcaggggagcggauacgccgcugacaaagaaucuacacagaaggccauugauggcgucaccaauaaagugaacuccaucauugacaagaugaacacccaauuugaggcuguuggcagagaguucaauaaccuggaacggcgcaucgagaaucuuaacaagaaaauggaagauggguuccuggacguguggacauauaaugccgagcuccugguccugauggaaaacgagagaacgcucgauuuucaugacagcaaugugaagaaccuguacgauaaaguucggcuucagcugagagacaaugccaaggaacucggaaacggcuguuucgaguuuuaccacaaaugcgauaaugaguguauggaaucugugcgcaacgggaccuaugacuacccccaguauagcgaggaagcucggcugaagagagaggagauuuccggagucaaacuugaaucuaucggcacauaccaaauucugagcaucuauuccaccguggcgagcucucucguccuggccaucaugguggcugggcugucccucuggaugugcagcaauggcucucugcagugccgcauuuguaucuga

SEQ ID NO: 190740 - RNA, 1704 nt, Artificial Sequence
  derived and/or modified sequence opt5 from hemagglutinin__InfluenzaA__AEO89172
auggagaagaucgugcugcuccuggccauugucagccuuguuagauccgaccagaucugcauuggcuaccacgcuaacaauucuaccgaacaaguggauacaaucauggagaaaaacgugacggucacccaugcccagaauauucuggaaaagacacacaacgggaaacucugugaccuggauggagugaagccccuuauccugcgggacugcagcguugcgggcuggcuccuggggaauccuaugugugaugaguucaucaacgugccggaaugguccuauauugucgagaaagcuaaucccgccaacgaccugugcuacccuggaaauuuuaacgauuaugaggaacucaagcaucugcuuucucgcaucaaucacuucgagaagauucagaucauucccaaaagcuccuggucugaccaugaagccagcuccggcgugagcucugcuuguccuuaccaggggacccccuccuuuuucagaaacguuguguggcugaucaagaaaaauaacacauauccuaccauuaagcggagcuacaauaacacaaaccaagaggaucuccugguccuuuggggaauccaccacucuaaugacgccaccgagcagaucaaacuguaucagaacccgacgaccuacguguccgugggcacaagcacccucaaucagcgccugguccccaagauugcuacaagaucuaagguuaacggccaauccgggcggauggacuuuuucuggaccauccugaaaagcaaugaugccauuaacuuugaauccaauggaaacuucaucgcgccugaguacgccuauaagauugugaaaaagggcgauucugcuaucaugaaaagcgaaguggaguacgggaauugcuccacgaagugucagacacccaucggagccauuaacagcucuaugccuuuucauaauauccacccccucaccauuggcgaaugcccgaaauaugucaaguccaacaagcuggugcuugcuacagggcugcgcaauagcccucucagagagcggcgcagaaaacggggacuguucggcgccaucgcgggcuuuauugaagggggauggcagggcaugguugacgggugguacggauaucaucacucuaacgaacagggcagcggguacgccgcugacaaggaguccacccaaaaagccaucgauggagugaccaauaaggucaacucuaucauugacaaaaugaacacacaguucgaagcugugggccgcgaguuuaauaaccuugaaagacggaucgagaaucugaacaagaagauggaggauggcuuccucgacguuuggacguauaaugccgaacugcuggugcucauggagaacgaacgcacccuggauuuccacgacagcaaugucaaaaaccuuuacgauaaggugagacugcagcuccgggacaaugccaaagagcuggggaacggauguuuugaguucuaccauaagugcgauaaugaguguauggaguccgucagaaacggcacauaugacuacccccaauauagcgaagaggcucgccuuaaacgggaagagauuucuggggugaagcuggaguccaucggaaccuaccagauucucagcaucuauucuacaguugcguccagccuggcccuggcuauuaugguggccggccucucccuguggaugugcucuaaugggagccuucagugcagaaucuguaucuga

SEQ ID NO: 190741 - RNA, 1704 nt, Artificial Sequence
  derived and/or modified sequence opt5 from hemagglutinin__InfluenzaA__AEO89181
auggagaagaucgugcuccuguucgccaccauuagccuggucaaauccgaccacaucugcauuggcuaccaugcuaacaauucuacagaacagguugauacgaucauggagaagaacgugaccgugacacacgcccaagacauucuugagaaaacccauaaugggaagcugugugaucucaacggagucaaaccccugauccuuaaggacugcagcguggcgggcuggcugcucgggaauccuaugugugaugaauuuaucaacguuccggaaugguccuauauuguggagaaggcuaaucccgccaacgaccugugcuacccuggaaauuucaacgauuaugaggaacugaaacaccuccugucuagaaucaaucauuuugagaagauucagaucauucccaaaaacagcugguccgaccacgaagccucucuuggcgucagcgcugccuguccuuaccaggggaaguccagcuucuuucggaaugugguuuggcugaucaaaaaggauaacgcuuaucccacaauuaagaaaggauacaauaacaccaaccaggaggaccuccuggugcuuuggggcauccaccauccuaaugaugaggccgaacaaacacgccuguaucagaacccgaccacguacaucucuauuggcaccuccacacucaaucagagacugguccccaagaucgcgacccggagcaaaauuaacgggcagucuggacgcaucgacuucuuuuggacaauucugaagccuaaugaugccauccacuucgaguccaacggcaauuuuaucgcucccgaauacgccuauaaaauugugaagaaaggggacagcaccaucaugaagucugagguggaauacggaaacugcaauacgagaugucaaacaccuauuggcgcuaucaacuccagcaugcccuuccauaauauucacccgcucaccaucggggagugcccuaaguaugucaaauccaacaagcugguucuugccacaggacugcgcaauucuccccagcgggagagacggcgcaaaagaggccucuuuggcgcgaucgccggguucauugaaggaggcuggcaggggaugguggacggaugguacggcuaucaccauagcaacgagcagggguccggauacgcugccgauaaggaaagcacccaaaaagcuaucgacggcgugaccaauaaggucaacucuauuaucgauaagaugaacacacaguuugaggccgugggccgggaguucaauaaccuggaacgcagaauugagaaucuuaacaaaaagauggaagacggguuccuggauguuuggacguauaaugccgagcuccuggugcugauggaaaacgagcggacccucgacuuucacgauuccaauguccgcaaccuguacgacaaagugagacuucagcugaaggauaaugcuaaagaacucggaaacggcuguuucgaguuuuaccauaagugcgacaaugaguguauggaaagcguucggaacgggacauaugauuacccucaauauucugaggaagcgagacugaagcgcgaggagaucagcggagugaaacuugaauccauuggcaucuaccagauccugucuauuuauagcaccgucgccuccagccucgugcuggcuaucaugauggccgggcugucucucuggaugugcuccaauggcagccugcagugccggauuuguaucuga

SEQ ID NO: 190742 - RNA, 1704 nt, Artificial Sequence
  derived and/or modified sequence opt5 from hemagglutinin__InfluenzaA__AEO89192
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccgcugagcagauuaagcuguaucagaacccgaccacguacgucuccaucggcaccagcacacucaaucagcggcuggugcccaagauugccacccgcucuaaagugaacggccaauccgggagaauggacuuuuucuggacaauccugaagccuaaugaugcgauuaacuuugaaagcaauggaaacuucaucgcccccgaguacgcuuauaaaaucgucaaggaaggcgauuccgccauuaugaaaucugagguugaauacgggaauugcaacaccaagugucagacgccuaucggagcuauuaauagcuccaugcccuuucauaacauccacccgcucacaauuggcgagugcccuaaauaugugaaaagcaauaagcuggugcuugccaccgggcugcggaacucuccccuccgcgagagacggcgcaaaagaggacuguucggcgcgaucgccggcuuuaucgaagggggauggcagggcauggucgacgggugguacggauauccucauuccaaugagcagggcagcggguacgcugccgacaaggaaucuacacaaaaagcuauugauggagugaccaacaagguuaacagcaucauugacaaaaugaauacccaguucgaggccgugggccgggaauuuaacaaucuugagcgcagaaucgagaaccugaauaagaagauggaagauggcuuccucgacgucuggacauauaacgccgagcugcuggugcucauggaaaaugagcggacgcuggauuuccacgacuccaacguuaaaaaucuuuacgauaaggugcgccugcagcucagagacaacgcuaaagaacuggggaauggauguuuugaguucuaccacaagugcgauaacgaguguauggaaucuguccggaauggcaccuaugacuacccccaauauagcgaggaagcgagacuuaaacgcgaggagauuaacggggugaagcuggaauccaucggaacauaccagauucucagcaucuauucuaccgucgccuccagccuggcucuggccaucaugguggccggccucucucuguggaugugcuccaaugggagccuucagugccggauuuguaucuga

SEQ ID NO: 190743 - RNA, 1704 nt, Artificial Sequence
  derived and/or modified sequence opt5 from hemagglutinin__InfluenzaA__AEO89203
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccgcugagcagauuaagcuguaucagaacccgaccacguacgucuccaucggcaccagcacacucaaucagcggcuggugcccaagauugccacccgcucuaaagugaacggccaauccgggagaauggacuuuuucuggacaauccugaagccuaaugaugcgauuaacuuugaaagcaauggaaacuucaucgcccccgaguacgcuuauaaaaucgucaaggaaggcgauuccgccauuaugaaaucugagguugaauacgggaauugcaacaccaagugucagacgccuaucggagcuauuaauagcuccaugcccuuucauaacauccacccgcucacaauuggcgagugcccuaaauaugugaaaagcaauaagcuggugcuugccaccgggcugcggaacucuccccuccgcgagagacggcgcaaaagaggacuguucggcgcgaucgccggcuuuaucgaagggggauggcagggcauggucgacgggugguacggauaucaucacuccaaugagcagggcagcggguacgcugccgacaaggaaucuacacaaaaagcuauugauggagugaccaacaagguuaacagcaucauugacaaaaugaauacccaguucgaggccgugggccgggaauuuaacaaucuugagcgcagaaucgagaaccugaauaagaagauggaagauggcuuccucgacgucuggacauauaacgccgagcugcuggugcucauggaaaaugagcggacgcuggauuuccacgacuccaacguuaaaaaucuuuacgauaaggugcgccugcagcucagagacaacgcuaaagaacuggggaauggauguuuugaguucuaccauaagugcgauaacgaguguauggaaucuguccggaauggcaccuaugacuacccucaauauagcgaggaagcgagacuuaaacgcgaggagauuaacggggugaagcuggaauccaucggaacauaccagauucucagcaucuauucuaccgucgccuccagccuggcucuggccaucaugguggccggccucucucuguggaugugcuccaaugggagccuucagugccggauuuguaucuga

SEQ ID NO: 190744 - RNA, 1704 nt, Artificial Sequence; identical to SEQ ID NO: 190743
  derived and/or modified sequence opt5 from hemagglutinin__InfluenzaA__AEO89213

SEQ ID NO: 190745 - RNA, 1704 nt, Artificial Sequence; identical to SEQ ID NO: 190743
  derived and/or modified sequence opt5 from hemagglutinin__InfluenzaA__AEO89224

SEQ ID NO: 190746 - RNA, 1704 nt, Artificial Sequence
  derived and/or modified sequence opt5 from hemagglutinin__InfluenzaA__AEO89235
auggagaagaucgugcugcuccuggccauggucagccuuguuagauccgaccagauuugcaucggcuaccacgcuaacaauucuaccgaacaaguggauacaauuauggagaaaaacgugacggucacccaugcccaggacauccuggaaaagacacacaaugggaaacucugugaucuggacggagugaagccccuuauucugcgggauugcagcguugcgggcuggcuccuggggaacccuaugugugacgaguucaucaaugugccggaaugguccuauaucgucgagaaagcuaaccccgccaaugaucugugcuacccuggaaaccucaaugacuaugaggaacugaagcaucuucugucucgcauuaaccacuuugagaagauccagauuauccccaaaagcuccuggucugaucaugaagccagccucggcguguccagcgcuuguccuuaccaggggacccccucuuucuuuagaaauguuauuuggcugaucaagaaaaacaauacauauccuaccauuaagcgguccuacaacaauacaaaccaagaggaccuucugauccucuggggaauccaccacagcaacgaugaggccgaacagauuaaacuguaucagaauccgaccacguacaucucugugggcaccuccacacugaaccagcgccucguccccaagauugcuaccagaagcaaggugaauggccaaucugggcggauggacuucuuuuggacaauccugaaaccugaugacgccauuaacuucgaguccaauggaaacuuuaucgcgcccgaauacgccuauaagaucgugaaaaagggcgacagcgcuauuaugaaauccgaggucgaauacgggaauugcaacaccaagugucagacgccuaucggagccauuaauucuagcaugcccuuccauaacauccacccgcuuacaauuggcgagugcccuaaauauguuaaguccaauaagcuggugcucgcuaccgggcugcgcaacagcccccuuagagagaaacggcgcaagagaggacuguuuggcgccaucgcgggcuucaucgaagggggauggcagggcaugguggaugggugguacggauaucaucacucuaaugagcagggcuccggguacgccgcugacaaagaaagcacacaaaaggccauugauggagucaccaacaaaguuaauucuaucauugacaagaugaacacccaguuugaggcugugggccgggaguucaacaaucucgaacgcagaaucgagaaccugaauaagaaaauggaagauggcuuucuggacguguggacauauaacgccgagcuccugguccuuauggaaaaugagcggacgcuggauuuccacgacagcaacgugaagaaucucuacgauaaaguucgccugcagcuuagagacaacgccaaggaacuggggaauggauguuucgaguuuuaccauaaaugcgauaacgaguguauggaauccgugcggaauggcaccuaugacuacccucaauauucugaggaagcuagacucaagcgcgaggagauuagcggggucaagcuggaauccaucggaacauaccagauucugagcaucuauucuaccguggcguccagccucgcccuggcuaucauggucgccggccuuucucuguggaugugcuccaacgggagccuccagugccggauuuguaucuga

SEQ ID NO: 190747 - RNA, 1704 nt, Artificial Sequence
  derived and/or modified sequence opt5 from hemagglutinin__InfluenzaA__AEO89246
auggagaagaucgugccccugcucgccauggucagccugguuaaauccgaccagauuugcaucggcuaccacgcuaacaauucuaccgaacaaguggauacaauuauggagaagaacgugacggucacccaugcccaggacauccuugaaaagacacacaaugggaaacugugugaucucgacggagugaaaccucugauucuuagagauugcagcguugcgggcuggcugcucgggaacccgaugugugacgaguucaucaaugugcccgaaugguccuauaucgucgagaaggcuaacccugccaaugaucugugcuaccccggaaaccugaaugacuaugaggaacucaagcaucugcuuucucggauuaaccacuuugagaaaauccagauuaucccuaagagcuccuggucugaucaugaagccagccugggcguguccagcgcuugucccuaccaggggaccccuucuuucuuucgcaauguuguguggcucauuaaaaagaacaauacauauccgaccaucaaaagauccuacaacaauacaaaccaagaggaccugcuuauucuguggggaauccaccacagcaacgaugaggccgaacagaucaagcucuaucagaaucccaccacguacauuucugucggcaccuccacacugaaccagcggcuggugccuaagaucgcuacccgcagcaaagugaauggccaaucugggagaauggacuucuuuuggacaauucucaagcccgaugacgccaucaacuucgaguccaauggaaacuuuauugcgccugaauacgccuauaaaaucgucaagaaaggcgacagcgcuaucaugaaguccgagguugaauacgggaauugcaacaccaaaugucagacgcccauuggagccaucaauucuagcaugccguuccauaacauucacccucugacaaucggcgagugccccaaguaugugaaguccaauaaacuugugcuggcuaccgggcuccggaacagcccucugcgcgagagacggcgcaagagaggacuuuuuggcgccauugcgggcuucaucgaagggggauggcagggcauggucgaugggugguacggauaucaucacucuaaugagcagggcuccggguacgccgcugacaaagaaagcacacaaaaggccaucgauggagugaccaacaaaguuaauucuauuaucgacaagaugaacacccaguuugaggcugugggccgggaguucagcaaccuggaacgcagaauugagaaucucaacaagaaaauggaagauggcuuucuggacgucuggacauauaaugccgagcugcucgugcugauggaaaacgagcggacgcuugauuuccacgacuccaauguuaagaaccuguacgauaaagugcgccuccagcugagagacaaugccaaggaacuugggaacggauguuucgaguuuuaccauaaaugcgauaaugaguguauggaaucuguccggaacggcaccuaugacuacccccaauauagcgaggaagcuagacugaagcgcgaggagaucuccggggugaagcucgaaagcauuggaacauaccagauccugucuauuuauuccaccgucgcgagcucucuggcccucgcuaucaugguggccggccugucccuuuggaugugcagcaaugggucccugcagugccggaucuguauuuga

SEQ ID NO: 190748 - RNA, 1704 nt, Artificial Sequence
  derived and/or modified sequence opt5 from hemagglutinin__InfluenzaA__AEO89257
auggagaagaucgugcugcuccuggccauugucagccuuguuagauccgaccagaucugcauuggcuaccacgcuaacaauucuaccgaacaaguggauacaaucauggagaaaaacgugacggucacccaugcccaggacauucuggaaaagacacacaaugggaaacucugugaucuggacggagugaagccccuuauccugcgggauugcagcguugcgggcuggcuccuggggaacccuaugugugacgaguucaucaaugugccggaaugguccuauauugucgagaaagcuaaccccgccaaugaucugugcuacccuggaaacuuuaaugacuaugaggaacucaagcaucugcuuucucgcaucaaccacuucgagaagauucagaucauucccaaaagcuccuggucugaucaugaagccagcuccggcgugagcucugcuuguccuuaccaggggacccccuccuuuuucagaaauguuguguggcugaucaagaaaaacaauacauauccuaccauuaagcggagcuacaacaauacaaaccaagaggaccuccugguccuuuggggaauccaccacucuaacgaugccgcugagcagaucaaacuguaucagaauccgaccacguacguguccgugggcaccagcacacucaaccagcgccugguccccaagauugccaccagaucuaagguuaauggccaauccgggcggauggacuuuuucuggacaauccugaaaagcaacgaugcgauuaauuuugaauccaacggaaauuucaucgccccugaguacgcuuauaagauugugaaaaagggcgacucugccaucaugaaaagcgaaguggaguacgggaacugcuccaccaagugucagacgcccaucggagcuauuaauagcucuaugccuuuucauaacauccacccccucacaauuggcgaaugcccgaaauaugucaaguccaauaagcuggugcuugccaccgggcugcgcaacagcccucucagagagcggcgcagaaaacggggacuguucggcgcgaucgccggcuuuauugaagggggauggcagggcaugguugacgggugguacggauaucaucacucuaaugaacagggcagcggguacgcugccgauaaggaguccacacaaaaagcuaucgacggagugaccaacaaggucaauucuaucauugauaaaaugaacacccaguucgaagccgugggccgcgaguuuaacaaucuugaaagacggaucgagaaccugaauaagaagauggaggacggcuuccucgauguuuggacauauaacgccgaacugcuggugcucauggagaaugaacgcacgcuggacuuccacgauagcaacgucaaaaaucuuuacgacaaggugagacugcagcuccgggauaacgcuaaagagcuggggaauggauguuuugaguucuaccauaagugcgacaacgaguguauggaguccgucagaaauggcaccuaugauuacccccaauauagcgaagaggcgcgccuuaaacgggaagagauuucuggggugaagcuggaguccaucggaacauaccagauucucagcaucuauucuaccguugccuccagccuggugcuggcuauuauggucgccggccucucccuguggaugugcucuaacgggagccuucagugcagaaucuguaucuga

SEQ ID NO: 190749 - RNA, 1704 nt, Artificial Sequence; identical to SEQ ID NO: 190748
  derived and/or modified sequence opt5 from hemagglutinin__InfluenzaA__AEO89268

SEQ ID NO: 190750 - RNA, 1704 nt, Artificial Sequence
  derived and/or modified sequence opt5 from hemagglutinin__InfluenzaA__AEO89279
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugggcgauugcagcguugcgggguggcuccugggaaacccuaugugugacaaguucaucaaugugccggagugguccuauauugucgaaaaggcuaaccccgccaaugaucugugcuacccuggcaacuuuaaugacuaugaggagcucaaacaucugcuuucuagaaucaaccacuucgaaaagauucagaucauucccaaaagcuccuggucugaucaugaggccagcuccggggugagcucugcuuguccuuaccagggaacccccuccuuuuuccggaauguuguguggcugaucaagaaaaacaauacauauccuaccauuaagcgcagcuacaacaauacaaaccaagaagaccuccugauccuuuggggcauccaccacucuaacaaugccgcugagcaggagaagcuguaucagaacccgaccacguacauuuccgucggcaccagcacacucaaucagagacuggugcccaaaaucgccacccggucuaaggugaacgggcaauccggacgcauggauuucuucuggacaauucugaaaccuaaugacgcgaucaacuuugaaagcaauggcaacuucauugcccccgaguacgcuuauaagaucgucaaaaagggggauuccgccaucaugaaaucuggaguuaaguacggcaauugcaacaccaagugucagacgccuauuggggcuaucaauagcuccaugcccuuucauaacauucacccgcucacaaucggagaaugcccuaaauaugugaaaagcaauaaacuggugcuugccaccggccugagaaacucuccccuccgggagcgcagacggaagcgcggccuguucggggcgauugccggauuuaucgaaggcggguggcagggaauggucgacggcugguacggguaucaucacuccaaugagcagggaagcggcuacgcugccgacaaagagucuacacaaaaggcuaucgauggcgugaccaacaagguuaacagcauuaucgacaaaaugaauacccaguucgaagccguggggagagaguuuaacaaucuugaacggcgcauugagaaccugaauaagaaaauggaagauggauuccucgacgucuggacauauaacgccgagcugcuggugcucauggagaaugaaagaacgcuggauuuccacgacuccaacguuaagaaucuuuacgauaaagugcggcugcagcuccgcgacaacgcuaaggagcugggcaauggguguuuugaauuuuaccauaagugcgauaacgaguguauggaaucugucagaaauggaaccuaugacuacccucaauauagcgaggaggcgcggcuuaaaagagaagagaucuccggcgugaagcuggaaagcauugggacauaccagauccucucuauuuauuccaccgccgcuagcucucuggcccuggccaucauggucgcuggccucucccuguggaugugcagcaacggaucccuucagugccgcaucuguauuuga

SEQ ID NO: 190751 - RNA, 1704 nt, Artificial Sequence
  derived and/or modified sequence opt5 from hemagglutinin__InfluenzaA__AEO89289
auggagaagaucgugcugcuccuggccauugucagccuugcuaaauccgaccagaucugcauuggcuaccacgccaacaauucuaccgaacaaguugauacaaucauggagaagaacgugacggugacccaugcgcaggacauucuggaaaagacacacaaugggaagcucugugaucuggacggagucaaaccccuuauccugggcgauugcagcguggcuggguggcuccugggaaacccuaugugugacaaguucaucaauguuccggagugguccuauauuguggaaaaggucaaccccgccaaugaucugugcuacccuggcaacuuuaaugacuaugaggagcucaaacaucugcuuucuagaaucaaccacuucgaaaagauuaaaaucauucccaagagcuccuggucugaucaugaggccagcuccggggugagcucugcuuguccuuaccagggaacccccuccuuuuuccggaauguuguguggcugaucaaaaagaacaauacauauccuaccauuaagcgcagcuacaacaauacaaaccaggaagaccuccugauccuuuggggcauccaccacucuaacaaugucgccgagcaagagaaacuguaucagaacccgaccacguacauuuccgugggcaccagcacacucaaucagagacuggugcccaagaucgcuacccggucuaaagucaacgggcaguccggacgcauggacuuuuucuggacaauucugaagccuaaugauaccaucaacuuugaaagcaauggcaacuucauugcccccgaguacgcguauaaaaucguuaagaaaggggauuccgccaucaugaagucuggaguggaauacggcaauugcaacacgaagugucaaacaccuauuggggcuaucaauagcuccaugcccuuucauaacauucacccgcucaccaucggagagugcccuaaauaugugaaaagcaauaaacugguccuugccacaggccugagaaacucuccccuccgggaacgcagacggaagcgcggccuguucggggcuauugccggauuuaucgagggcggguggcagggaaugguggacggcugguacggguaucaucacuccaaugagcagggaagcggcuacgcggccgacaaagaaucuacccagaaggcuaucgauggcguuaccaacaaggugaacagcauuaucgacaaaaugaauacacaauucgaggccgucgggagagaauuuaacaaucuugagcggcgcauugaaaaccugaauaagaaaauggaggauggauuccucgacguguggacguauaacgcugagcugcugguucucauggaaaaugagagaacccuggauuuccacgacuccaacgugaagaaucuuuacgauaaaguccggcugcagcuccgcgacaacgccaaggaacugggcaauggguguuuugaguucuaccauaagugcgauaacgaauguauggagucugugagaaauggaacauaugacuacccucgguauagcgaggaagccagacuuaaacgcgaggaaaucuccggcgucaagcuggagagcauugggaccuaccagauccucucuauuuauuccacagcugcgagcucucuggcccuggcuaucaugguggccggccucucccuguggaugugcagcaacggaucccuucaaugccggaucuguauuuga

SEQ ID NO: 190752 - RNA, 1704 nt, Artificial Sequence
  derived and/or modified sequence opt5 from hemagglutinin__InfluenzaA__AEO89300
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccgcugagcagauuaagcuguaucagcauccgaccacguacaucuccgucggcaccagcacacucaaccagcggcuggugcccaagauugccacccgcucuaaagugaauggccaauccgggagaauggacuuuuucuggacaauccugaagccuaacgaugcgauuaauuuugaaagcaacggaaauuucaucgcccccgaguacgcuuauaaaaucgucaaggaaggcgauuccgccauuaugaaaucugagguugaauacgggaacugcaauaccaagugucagacgccuaucggagcuauuaacagcuccaugcccuuucacaauauccauccgcucacaauuggcgagugcccuaaauaugugaaaagcaacaagcuggugcuugccaccgggcugcgcaauucuccccuccgggagagacggcgcaaaagaggacuguucggcgcgaucgccggcuuuaucgaagggggauggcagggcauggucgacgggugguacggauaucaccacuccaacgagcagggcagcggguacgcugccgacaaggaaucuacacaaaaagcuauugauggagugaccaauaagguuaacagcaucauugacaaaaugaacacccaguucgaggccgugggccgggaauuuaauaaccuugagcgcagaaucgagaaucugaacaagaagauggaagauggcuuccucgacgucuggacauauaaugccgagcugcuggugcucauggaaaacgagcggacgcuggauuuccaugacuccaauguuaaaaaccuuuacgauaaggugcgccugcagcucagagacaaugcuaaagaacuggggaacggauguuuugaguucuaccacaagugcgauaaugaguguauggaaucuguccggaacggcaccuaugacuacccucaauauagcgaggaagcgagacuuaaacgcgaggagauuaauggggugaagcuggaauccaugggaacauaccagauccucagcauuuauucuaccgucgccuccagccuggcucuggccaucaugguggccggccucucuuuuuggaugugcuccaacgggagccugcagugccggaucuguauuuga

SEQ ID NO: 190753 - RNA, 1704 nt, Artificial Sequence
  derived and/or modified sequence opt5 from hemagglutinin__InfluenzaA__AEO89311
auggagaagaucgugcuccuguucgccauugucagccugguuaaauccgaccacaucugcauuggcuaccaugcuaacaauucuaccgaacagguggauacaaucauggagaagaacgugacggucacccacgcccaagacauucuugagaaaacacauaaugggaagcugugugaucucaacggagugaaaccccugauccuuaaggacugcagcguugcgggcuggcugcucgggaauccuaugugugaugaauuuaucaacgugccggaaugguccuauauugucgagaaggcuaaucccgccaacgaccugugcuacccuggaaauuucaacgauuaugaggaacugaaacaccuccugucuagaaucaaucauuuugagaagauucagaucauucccaaagacagcugguccgaucacgaagccucucuuggcgugagcgcugccuguccuuaccaggggaacuccagcuucuuucggaauguuguguggcugaucaagaaagacaacgcuuaucccaccauuaagaagucuuacaauaacacaaaccaggaggaucuccugauccuuuggggaauccaccauccuaaugacgaggccgaacaaacccgccuguaucagaacccgacaaccuacauuuccaucggcacgagcacccucaaucagagacugguccccaaaauugcgacacggucuaaggugaacggccaguccgggcgcaucgauuucuuuuggaccauucugaaaccuaaugacgccauccacuucgagagcaacggaaauuuuaucgcucccgaauacgccuauaagauugugaaaaagggcgacucuacaaucaugaaauccgaggucgaauacgggaacugcaauaccagaugucaaacgccuaugggagcuauuaacagcuccaugcccuuccauaauauccacccgcucacaauuggcgagugcccuaaguauguuaagucuaccaaacuggugcuugccacagggcugcggaacagcccccagcgcgagagacggcgcaagagaggacucuuuggcgcgaucgccggcuucaucgaagggggauggcagggcaugguggaugggugguacggauaucaccauuccaaugagcagggcagcggguacgcugccgacaaagaaucuacccaaaaggcuauugauggagucaccaacaaaguuaauuccaucauugacaagaugaacacacaguuugaggccgugggccgggaguucaacaagcuggaacgcagaaucgagaaucuuaacaaaaagauggaagauggcuuccuggacguguggacguauaaugccgagcuccugguccugauggaaaacgagcggacccucgauuuucacgacagcaaugugaaaaaccuguacgauaagguucgccuucagcugagagacaaugcuaaagaacucgggaacggauguuucgaguuuuaccauaagugcaauaacgaguguauggaaucugugcggaauggcacauaugauuacccucaauauagcgaggaagcgagacugaagcgcgaggagauuuccggggucaaacuugaaucuaucggaauuuaccagauccugagcaucuauuccaccguggccagcucucucguccuggcuauuaugauggccggccugucccucuggaugugcagcaacgggucucugcagugccggaucuguauuuga

SEQ ID NO: 190754 - RNA, 1701 nt, Artificial Sequence; identical to SEQ ID NO: 184952
  derived and/or modified sequence opt5 from hemagglutinin__InfluenzaA__AEO99215

SEQ ID NO: 190755 - RNA, 1698 nt, Artificial Sequence
  derived and/or modified sequence opt5 from hemagglutinin__InfluenzaA__AEQ38187
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcugaccagaaaacccuguaccauacagagaacgccuacguguccguggucagcucccacuauucuagaaaguucacccccgaaauugcgaagcggccuaaaguucgcgaucaggagggcagaaucaauuacuauuggacgcuucuggagcccggggacacaauuaucuuugaagccaacggaaaucucauugcuccucgguacgccuucgcucugagccgcggcuuuggguccggaaucauuaacagcaaugcccccauggauaagugugacgcgaaaugccagaccccgcaaggcgccaucaacucuucccuuccuuuccagaaugugcaucccgugacaaucggcgaguguccuaaguaugucagaagcgcuaaacugcggauggugaccgggcuccgcaacauucccucuauccagagcagaggacuguuuggcgccauugcuggguucaucgaaggaggcuggaccgggaugguugauggaugguacggcuaucaccaccagaaugagcaaggcuccggguacgccgccgaccagaagucuacacagaacgcuauuaauggaaucacgaacaaagugaauagcgucaucgaaaagaugaacacccaguuuacagcggugggcaaggaguucaacaaacuggagcggcgcauggaaaaucucaacaagaaaguugaugacggguucauugauaucuggaccuacaaugccgagcugcuugugcugcucgaaaacgagagaacacuggacuuucaugacuccaaugucaagaaccuuuaugaaaaagucaagagccaacugaagaauaacgcuaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcgugaagcuggaaucuaugggaguuuaccagauucuggccaucuauuccacgguggccagcucccucguccugcuugugucucugggcgcuaucagcuucuggaugugcuccaaugggucucuccagugucgcauuugcaucuga

SEQ ID NO: 190756 - RNA, 1698 nt, Artificial Sequence; identical to SEQ ID NO: 190755
  derived and/or modified sequence opt5 from hemagglutinin__InfluenzaA__AEQ38188

SEQ ID NO: 190757 - RNA, 1698 nt, Artificial Sequence
  derived and/or modified sequence opt5 from hemagglutinin__InfluenzaA__AEQ38189
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgccaaccagaaaacccuguaccauacagagaaugcuuacguguccgucguuagcucccacuauucuagaaaguucacccccgaaauugccaagcggccuaaagugcgcgaccaggagggcagaaucaacuacuauuggacgcuucuggagcccggggauacaauuaucuuugaagcgaauggaaaccucauugccccucgguacgcuuucgcccugagccgcggcuuuggguccggaaucauuaauagcaacgcucccauggacaagugugaugccaaaugccagaccccgcaaggcgcgaucaauucuucccuuccuuuccagaacgugcaucccgucacaaucggcgaguguccuaaguaugugagaagcgccaaacugcggaugguuaccgggcuccgcaauauucccucuauccagagcagaggacuguuuggcgcuauugccggguucaucgaaggaggcuggaccgggaugguggacggaugguacggcuaucaccaccagaacgagcaaggcuccggguacgcugccgaucagaagucuacacagaaugccauuaacggaaucacgaauaaagucaacagcgugaucgaaaagaugaacacccaguuuacagcuguuggcaaggaguucaauaaacuggagcggcgcauggaaaaccucaauaagaaaguggacgauggguucauugacaucuggaccuacaacgcggagcugcuuguccugcucgaaaaugagagaacacuggauuuucaugacuccaacgugaagaaucuuuaugaaaaagucaagagccaacugaagaacaaugccaaagagauuggaaacggcugcuucgaguuuuaccacaaguguaaugacgaaugcauggagucugugaaaaacgggaccuaugauuaccccaaguauuccgaagagagcaaacucaaucgggagaagaucgacggcguuaagcuggaaucuaugggaguguaccagauucuggcuaucuauuccacggucgccagcucccucgugcugcuuguuucucugggcgccaucagcuucuggaugugcuccaacgggucucuccagugucgcauuugcaucuga

SEQ ID NO: 190758 - RNA, 1698 nt, Artificial Sequence
  derived and/or modified sequence opt5 from hemagglutinin__InfluenzaA__AEQ38190
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacaggcaaaaacgggcucuaccccaaucugagcaagccuuaugcuaacaacaaagagaaggaagugcugguccucuggggagugcaccacccgcccaauaucgccgugcagaaaacccuguaccauacagagaacgcuuacgucucuguuguguccagccacuauuccagaaaguucaccccugaaauugccaagcggcccaaagugcgcgaccaggagggcagaaucaauuacuauuggacgcuucuggagccuggggauacaauuaucuuugaagcgaacggaaaucucauugcuccccgguacgccuucgcccugucucgcggcuuugggagcggaaucauuaacuccaaugcuccgauggacaagugugaugccaaaugccagaccccucaaggcgcgaucaacagcucucuucccuuccagaauguccauccugugacaaucggcgagugucccaaguauguuagauccgccaaacugcggauggugaccgggcuccgcaacauucccagcauccagucuagaggacuguuuggcgcuauugccggguucaucgaaggaggcuggaccgggauggucgacggaugguacggcuaucaccaccagaaugagcaaggcagcggguacgcugccgaucagaaguccacacagaacgccauuaauggaaucacgaacaaaguuaauucugugaucgaaaagaugaacacccaguuuacagcugugggcaaggaguucaacaaacuggagcggcgcauggaaaaucucaacaagaaagucgacgauggguucauugacaucuggaccuacaaugcggagcugcuugugcugcucgaaaacgagagaacacuggauuuucaugacagcaaugucaagaaccuuuaugaaaaagugaagucccaacugaagaauaacgccaaagagauuggaaauggcugcuucgaguuuuaccacaaguguaacgacgaaugcauggagagcguuaaaaaugggaccuaugauuacccuaaguauucugaagaguccaaacucaaccgggagaagaucgacggcgugaagcuggaaagcaugggagucuaccagauucuggcuaucuauucuacgguggccuccagccucguucugcuugugucccugggcgccaucucuuucuggaugugcagcaaugggucccuccagugucgcauuugcaucuga

SEQ ID NO: 190759 - RNA, 1698 nt, Artificial Sequence; identical to SEQ ID NO: 186650
  derived and/or modified sequence opt5 from hemagglutinin__InfluenzaA__AEQ38191

SEQ ID NO: 190760 - RNA, 1698 nt, Artificial Sequence
  derived and/or modified sequence opt5 from hemagglutinin__InfluenzaA__AEQ38192
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaauuacgaagcggccuaaagugcgcgaucaggagggcagaaucaauuacuauuggacacuucuggagcccggggacaccauuaucuuugaagcuaacggaaaucucauugccccucgguacgcguucgcccugucucgcggcuuuggguccggaaucauuaacagcaauacacccauggauaagugugacaccaaaugccagaccccgcaaggcgcuaucaacucuagccuuccuuuccagaaugugcaucccgucacaaucggcgaguguccuaaguaugugagauccgccaaacugcggaugguuacggggcuccgcaacauucccucuauccagagcagaggacuguuuggcgcuauugccggguucaucgaaggaggcuggaccgggaugguggauggaugguacggcuaucaccaccagaaugagcaaggcuccggguacgcggccgaccaaaagagcacacagaacgcuauuaauggaaucaccaacaaagucaauucugugaucgaaaagaugaacacacaguuuaccgccguuggcaaggaguucaauaaacuggagcggcgcauggaaaaccucaacaagaaaguggaugacggguucauugauaucuggacguacaaugcugagcugcuuguccugcucgaaaacgagagaacacuggacuuucaugacuccaaugugaagaaccuuuaugaaaaagucaagagccagcugaagaauaacgccaaagagauuggaaauggcugcuucgaguuuuaccacaaguguaacgaugaaugcauggagucugugaaaaaugggaccuaugacuaccccaaguauuccgaagagagcaaacucaaccgggagaagaucgauggcguuaagcuggaauccaugggaguguaccagauucuggccaucuauucuaccgucgcuagcucccucgugcugcuuguuucucugggcgcgaucagcuucuggaugugcuccaaugggagccuccagugucgcauuugcaucuga

SEQ ID NO: 190761 - RNA, 1698 nt, Artificial Sequence
  derived and/or modified sequence opt5 from hemagglutinin__InfluenzaA__AEQ38193
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguucuggugcucuggggaguccaccacccuccgaacauuguggaccagaaaacccuguacagaacagagaaugccuacgugagcgucguuuccucucauuauagccggaaguucacccccgaaaucgcuaagcgcccuaaagugagagaucaggagggccggauuaacuacuauuggacgcuucuggagcccggggacacaaucauuuuugaagccaauggaaaccucaucgcgccucgcuacgccuucgcucuguccagaggcuuugggagcggaauuaucaauucuaacgcccccauggauaagugugacgcuaaaugccagaccccgcaaggcgccaucaauuccagccuuccuuuccagaacgugcaccccgucacaauuggcgaguguccuaaguaugugcggucugcgaaacugcgcaugguuaccgggcucagaaauauccccagcauucagucccggggacuguuuggcgccaucgcuggguucauugaaggaggcuggaccgggaugguggauggaugguacggcuaucaucaccagaacgagcaaggcucuggguacgccgcugaccaaaagagcacacagaaugccaucaacggaaucacgaauaaagucaacuccgugauugaaaagaugaauacccaguuuacagccguuggcaaggaguucaacaaacuggagcgcagaauggaaaaccucaauaagaaaguggaugacggguucaucgauauuuggaccuacaacgcugagcugcuuguccugcucgaaaaugagcggacacuggacuuucacgacagcaacgugaagaaucuuuaugaaaaagucaagucucagcugaagaacaaugcgaaagagaucggaaacggcugcuucgaguuuuaccauaaguguaaugaugaaugcauggaguccgugaaaaacgggaccuaugacuaccccaaguauagcgaagagucuaaacucaaucgcgagaagauugauggcguuaagcuggaauccaugggaguguaccagauccuggccaucuauagcacggucgcuuccucucucgugcugcuuguuagccugggcgccauuuccuucuggaugugcucuaacgggagccuccaguguagaaucugcauuuga

SEQ ID NO: 190762 - RNA, 1698 nt, Artificial Sequence
  derived and/or modified sequence opt5 from hemagglutinin__InfluenzaA__AEQ38194
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccgaccagaaaacccuguaccauacagagaacgccuacgugucugucguuagcucccacuauagcagaaaguucacccccgaaauugcuaagcggccuaaagugcgcgaucaggagggcagaaucaauuacuauuggacgcuucuggagcccggggacacaauuaucuuugaagccucuggaaaccucauugcgccucgguacgccuucgcucugucccgcggcuuugggagcggaaucauuaauucuaacgcccccauggauaagugugacgcuaaaugccagaccccgcaaggcgccaucaauagcucccuuccuuuccagaacgugcaucccgucacaaucggcgaguguccuaaguaugugagaucugcgaaacugcggaugguuaccgggcuccgcaauauucccagcauccaguccagaggacuguuuggcgccauugcuggguucaucgaaggaggcuggaccgggaugguggauggaugguacggcuaucaccaccggaacgagcagggcagcggguacgccgcugaccaaaagucuacacagaaugccauuaacggaaucacgaauaaagucaacuccgugaucgaaaagaugaauacccaguuuacagccguuggcaaggaguucaacaaacuggagcgcagaauggaaaaucucaacaagcggguggaugacggguucauugauaucuggaccuacaacgcugagcugcuuguccugcucgaaaaugagcgcacacuggacuuucaugacagcaacgugaaaaaucuuuaugaaaaggucaaaucucagcugaagaacaaugcgaaggagauuggaaacggcugcuucgaguuuuaccacaaauguaaugaugaaugcauggaguccgugaagaacgggaccuaugacuaccccaaauauagcgaagaguccaagcucaauagagagaaaaucgauggcguuaagcuggaaucuaugggaguguaccaaauucuggccaucuauagcacggucgcuuccucucucgugcugcuuguuagccugggcgccaucuccuucuggaugugcagcaacgggucucuccagugucggauuugcaucuga

SEQ ID NO: 190763 - RNA, 1698 nt, Artificial Sequence
  derived and/or modified sequence opt5 from hemagglutinin__InfluenzaA__AEQ38195
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcuaaccagaaaacccuguaccauacagagaaugccuacguguccguggucagcucccacuauucuagaaaguucacccccgaaauugcgaagcggccuaaaguucgcgaccaggagggcagaaucaacuacuauuggacgcuucuggagcccggggauacaauuaucuuugaagccaauggaaaccucauugcuccucgguacgccuucgcucugagccgcggcuuuggguccggaaucauuaauagcaacgcccccauggacaagugugaugcgaaaugccagaccccgcaaggcgccaucaauucuucccuuccuuuccagaacgugcaucccgugacaaucggcgaguguccuaaguaugucagaagcgcuaaacugcggauggugaccgggcuccgcaauauucccucuauccagagcagaggacuguuuggcgccauugcuggguucaucgaaggaggcuggaccgggaugguugacggaugguacggcuaucaccaccagaacgagcaaggcuccggguacgccgccgaucagaagucuacacagaaugcuauuaacggaaucacgaauaaagugaacagcgucaucgaaaagaugaacacccaguuuacagcgaugggcaaggaguucaauaaacuggagcggcgcauggaaaaccucaauaagaaaguggacgauggguucauugacaucuggaccuacaacgccgagcugcuuguucugcucgaaaaugagagaacacuggauuuucaugacuccaacgugaagaaucuuuaugaaaaagucaagagccaacugaagaacaaugcuaaagagauuggaaacggcugcuucgaguuuuaccacaaguguaaugacgaaugcauggagucugugaaaaacgggaccuaugauuaccccaaguauuccgaagagagcaaacucaaucgggagaagaucgacggcgucaagcuggaaucuaugggaguguaccagauucuggccaucuauuccacgguugccagcucccucgugcugcuugucucucugggcgcuaucagcuucuggaugugcuccaacgggucucuccagugucgcauuugcaucuga

SEQ ID NO: 190764 - RNA, 1698 nt, Artificial Sequence
  derived and/or modified sequence opt5 from hemagglutinin__InfluenzaA__AEQ38196
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggagccuccgcuagcugcucucauaauggcgaaaacuccuuuuaucgcaaucugcuuuggcugacaggcaaaaacgggcucuaccccaaucugagcaagucuuaugccaacaacaaagagaaggaaguucuggugcucuggggaguccaccacccuccgaauaucgcugaccagaaaacccuguaccauacagagaacgccuacguguccguggucagcucccacuauucuagaaaguucacccccgaaauugcgaagcggccuaaaguucgcgaucaggagggcagaaucaauuacuauuggacgcuucuggagcccggggacacaauuaucuuugaagccaacggaaaucucauugcuccucgguacgccuucgcucugagccgcggcuuuggguccggaaucauuaacagcaaugcccccauggauaagugugacgcgaaaugccagaccccgcaaggcgccaucaacucuucccuuccuuuccagaaugugcaucccgugacaaucggcgaguguccuaaguaugucagaagcgcuaaacugcggauggugaccgggcuccgcaacauucccucuauccagagcagaggacuguuuggcgccauugcuggguucaucgaaggaggcuggaccgggaugguugauggaugguacggcuaucaccaccagaaugagcaaggcuccggguacgccgccgaccagaagucuacacagaacgcuauuaauggaaucacgaacaaagugaauagcgucaucgaaaagaugaacacccaguuuacagcggugggcaaggaguucaacaaacuggagcggcgcauggaaaaucucaacaagaaaguugaugacggguucauugauaucuggaccuacaaugccgagcugcuugugcugcucgaaaacgagagaacacuggacuuucaugacuccaaugucaagaaccuuuaugaaaaagucaagagccaacugaagaauaacgcuaaagagauuggaaauggcugcuucgaguuuuaccacaaguguaacgaugaaugcauggagucugugaaaaaugggaccuaugaauaccccaaguauuccgaggagagcaaacucaaccgggaaaagaucgacggcgugaagcuggagucuaugggaguuuaccagauucuggccaucuauuccacgguggccagcucccucguccugcuugugucucugggcgcuaucagcuucuggaugugcuccaaugggucucuccagugucgcauuugcaucuga

SEQ ID NO: 190765 - RNA, 1698 nt, Artificial Sequence; identical to SEQ ID NO: 190755
  derived and/or modified sequence opt5 from hemagglutinin__InfluenzaA__AEQ38197

SEQ ID NO: 190766 - RNA, 1698 nt, Artificial Sequence; identical to SEQ ID NO: 190755
  derived and/or modified sequence opt5 from hemagglutinin__InfluenzaA__AEQ38198

SEQ ID NO: 190767 - RNA, 1701 nt, Artificial Sequence; identical to SEQ ID NO: 190074
  derived and/or modified sequence opt5 from hemagglutinin__InfluenzaA__AEQ62909

SEQ ID NO: 190768 - RNA, 1701 nt, Artificial Sequence
  derived and/or modified sequence opt5 from hemagglutinin__InfluenzaA__AEQ62910
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccgccuccccggacaacggcacgugcuaucccggggauuuuauugacuacgaagaacuccgggagcagcugucuagcgucuccagcuucgaacgcuuugagaucuucccuaagaccucuuccuggcccaaucacgauagcaacaagggagugacagcugccuguccucaugcgggcgccaaaucuuuuuauaagaaucuuauguggcugguuaaaaagggcaacuccuaccccaaacucagcaagucuuauaucaaugacaaggggaaagaagugcugguccuuuggggcauucaccacccuccgaccuccgcugaucaacagagccuguaccagaacgccgacgcuuacguguucgugggaacauccagauauucuaagaaauuuaagcccgagaucgccauucggccuaaaguccgcgggcaggagggaagaaugaauuacuauuggacccucguugaacccggcgauaagaucacguucgaggcgacagggaaccugguggugccucgguacgccuuugcuauggaacgcaacgccggaagcggcauuaucauuuccgacacccccguccaugauugcaauacaaccugucaaagcccgaaaggcgcuaucaacaccucucugccuuuccagaauauccaccccauuacaaucggggagugcccuaaguaugugaaguccacgaaacucagacuggccaccggacuucggaacguucccagcgugcagucucgcggccuguuuggggccauugcuggauucaucgaaggcggguggacaggaauggucgacggcugguacggcuaucaucaccagaaugagcaagggagcggauacgcggccgaccucaaguccacccagaacgcuauugaugagaucacaaauaaagugaacucuguuaucgaaaagaugaauacccaguuuacggccgugggcaaagaguucaaccagcuggaaaagagaauugagaaucuuaacaagaaagucgacgauggguuccuggacaucuggacauacaaugccgaacuccuggugcugcucgagaacgagcggacccuggauuaucacgacagcaaugucaagaaccuuuacgaaaaagugcgcucccaacugaagaacaaugcuaaagagauuggaaacggcuguuuugaguucuaucauaagugcgauaauaccuguauggagagcguuaagaacgggacauacgacuaucccaaauacucugaagaggccaagcucaauagagaggaaaucgauggcgugaaacuggaguccacccggauuuaucagauccuugcgaucuacagcacagucgcuucuucccuggugcucguugugagccugggagccauuuccuuuuggaugugcucuaacggcagccugcagugccgcaucuguauuuga

SEQ ID NO: 190769 - RNA, 1701 nt, Artificial Sequence; identical to SEQ ID NO: 189891
  derived and/or modified sequence opt5 from hemagglutinin__InfluenzaA__AEQ62911

SEQ ID NO: 190770 - RNA, 1701 nt, Artificial Sequence; identical to SEQ ID NO: 190074
  derived and/or modified sequence opt5 from hemagglutinin__InfluenzaA__AEQ62912

SEQ ID NO: 190771 - RNA, 1701 nt, Artificial Sequence
  derived and/or modified sequence opt5 from hemagglutinin__InfluenzaA__AEQ62915
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaccaacgccaaggagauugggaauggauguuuugaguucuaucacaaaugcgauaacacauguauggaaagcgugaagaauggcacguacgacuauccuaaauacucugaagaggcuaagcugaacagagaagagaucgaugggguuaaacuugaguccacccggaucuaucaaauucuggccaucuacagcacaguggcgucuucccucguccuggugguuagccugggcgcuauuuccuuuuggaugugcucuaauggaagccuccagugccgcaucuguauuuga

SEQ ID NO: 190772 - RNA, 1701 nt, Artificial Sequence; identical to SEQ ID NO: 186435
  derived and/or modified sequence opt5 from hemagglutinin__InfluenzaA__AER08646

SEQ ID NO: 190773 - RNA, 1701 nt, Artificial Sequence; identical to SEQ ID NO: 188443
  derived and/or modified sequence opt5 from hemagglutinin__InfluenzaA__AER08648

SEQ ID NO: 190774 - RNA, 1701 nt, Artificial Sequence
  derived and/or modified sequence opt5 from hemagglutinin__InfluenzaA__AER08652
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcugaucaauuccaccggaaaccucauugccccucgcggcuacuucaagaucagaagcgggaagucuuccaucaugcggagcgacgcucccauuggaaaauguaauucugagugcaucacaccgaacggcagcauuccuuccgacaagcccuuucagaaugugaaccgcaucacguauggcgccuguccuagauacgugaaacaaaauacccugaaacuugcgacagggaugcggaacguccccgaaaaacagacccgcggaauuuucggcgccaucgcuggguuuaucgagaauggaugggaaggcaugguugaugggugguauggauucagacaccagaacucugagggccggggccaagccgcugaccucaagagcacacaggccgccauugaucagaucaaugggaaacugaacagacugauuggaaagaccaaugagaaguuccaccagaucgaaaaagaguuuuccgaaguggagggccgcauucaagaccuugaaaaguacguggaggauacgaaaaucgaccuguggagcuauaacgcugagcuccuggucgcgcuggaaaaccagcauacaauugaucucaccgacucugagaugaauaagcuguucgaaaagaccaagaagcagcuucgggagaacgccgaagauauggggaauggaugcuuuaaaaucuaccacaagugugacaacgcuugcaucggcuccauuagaaaugggacauaugaucaugacguguaccgcgacgaggcccugaacaaucgguuccagaucaaaggcguugagcucaagagcggauacaaagauuggauucuguggaucucuuuugccauuuccugcuuccuucuguguguggcucuccugggcuuuaucaugugggccugccaaaaggggaacaucagauguaauauuugcaucuga

SEQ ID NO: 190775 - RNA, 1701 nt, Artificial Sequence; identical to SEQ ID NO: 190774
  derived and/or modified sequence opt5 from hemagglutinin__InfluenzaA__AER08654

SEQ ID NO: 190776 - RNA, 1701 nt, Artificial Sequence
  derived and/or modified sequence opt5 from hemagglutinin__InfluenzaA__AER08656
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuucucuaugcgcaagccucuggacgcauuacaguuuccaccaagagaagccagcagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaugcagagcgggaagucuuccaucaugagaagcgacgcccccaucggaaaauguaauucugagugcauuacaccgaacggcagcaucccuaaugacaagcccuuucaaaacgugaaucggauuacguauggcgcuuguccucgcuacgucaaacagaacacccugaaacuugccacagggaugagaaauguucccgaaaaacagacccggggaaucuucggcgcgauugccggguuuaucgagaacggaugggaaggcaugguggaugggugguauggauuccgccaccaaaauuccgagggcagaggccaggcugccgaccugaagucuacacaggcugccaucgaucagauuaacgggaaacucaaucggcugaucggaaagaccaacgagaaguuccaccaaauugaaaaagaguuuagcgaaguggagggcagaauccaggaccuugaaaaguacgucgaggauacgaaaauugaccugugguccuauaacgccgagcuccugguggcucuggaaaaucagcauacaaucgaucucaccgacagcgagaugaacaagcuguucgaaaagaccaagaagcagcuucgcgagaaugcggaagauauggggaacggaugcuuuaaaauuuaccacaagugugacaaugccugcaucggcucuauccggaacgggacauaugaucaugacguuuacagagacgaggcucugaauaaccgcuuccaaauuaaaggcguggagcucaaguccggauacaaagauuggauccuguggauuagcuuugccaucucuugcuuccuucugugugucgcccuccugggcuuuauuaugugggcuugccagaaggggaauauccgguguaacaucugcauuuga

SEQ ID NO: 190777 - RNA, 1701 nt, Artificial Sequence
  derived and/or modified sequence opt5 from hemagglutinin__InfluenzaA__AER08660
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucggaucagcauuuacuggacaaucgugaaacccggggacauucugcugaucaauuccaccggaaaccucauugccccucgcggcuacuucaagaucagaagcgggaaaucuuccaucaugcggagcgaugcucccauuggaaaguguaauucugccugcaucaccccgaacggcagcauuccuaaugacaagcccuuucagaacgugaaucgcaucacauauggcgcguguccuagauacgucaaacaaaacacgcugaaacuugccaccgggaugcggaauguucccgaaaaacagacacgcggaauuuucggcgcuaucgccggguuuaucgagaacggaugggaaggcaugguggacgggugguauggauucagacaccaaaauuccgagggccggggccaggcugccgaucugaagucuacccaggccgcuauugaccagaucaacgggaaacucaacagacugauuggaaagacaaaugagaaauuccaccagaucgaaaaggaguuuagcgaaguggagggccgcauucaagaucuugaaaaguacgucgaggacaccaaaaucgaucugugguccuauaacgcggagcuccugguggcccuggaaaaucagcauacgauugaccucacagauagcgagaugaacaagcuguucgaaaagaccaagaaacagcuucgggagaaugcugaagacauggggaacggaugcuuuaagaucuaccacaagugugauaaugccugcaucggcucuauuagaaacgggaccuaugaccaugauguuuaccgcgacgaggcccugaauaaccgguuccagaucaaaggcguggagcucaaguccggauacaaagacuggauucuguggaucagcuuugcuauuucuugcuuccuucugugugucgcccuccugggcuuuaucaugugggcgugccaaaaggggaauaucagauguaacauuugcaucuga

SEQ ID NO: 190778 - RNA, 1701 nt, Artificial Sequence
  derived and/or modified sequence opt5 from hemagglutinin__InfluenzaA__AER08664
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacucugaguccuucaauuggaccggagugacacagaacggcaccagcucugcuugcauccgcagauccaauaacagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaagccuccggacgcauuacaguuagcaccaagagaucccagcaggcugugaucccgaauauuggcucucggccccgcgucagaaacaucccuagccggaucuccauuuacuggacaaucgugaaacccggggauauucugcugaucaauagcaccggaaaccucauugccccucgcggcuacuucaagaucagaucugggaaauccagcaucaugcggucugacgcucccauuggaaaguguaauagcgaaugcaucaccccgaacggcuccauuccuaaugacaagcccuuucagaacgugaaucgcaucacauauggcgccuguccuagauacgucaaacaaucuacgcugaaacuugcgaccgggaugcggaacguucccgagaagcagacacgcggaauuuucggcgccaucgcuggguuuaucgaaaauggaugggagggcaugguggaugggugguauggauucagacaccagaacagcgagggccggggccaagccgcugaccugaaguccacccaggccgccauugaucagaucaaugggaaacucaacagacugauuggaaagacaaaugaaaaauuccaccagaucgagaaggaauuuagcgagguggaaggccgcauucaagaccuugagaaguacgucgaggauaccaaaaucgaccuguggucuuauaacgcugaacuccugguggcgcuggagaaccagcauacgauugaucucacagacuccgaaaugaauaagcuguucgagaaaaccaagaaacagcuucgggaaaacgccgaggauauggggaauggaugcuuuaagaucuaccacaagugugacaacgcuugcaucggcagcauuagaaaugggaccuaugaucaugacguuuaccgcgacgaggcccugaacaaucgguuccagaucaaaggcguggaacucaagucuggauacaaagauuggauucuguggaucuccuuugccauuagcugcuuccuucugugugucgcucuccugggcuuuaucaugugggccugccaaaaggggaacaucagauguaauauuugcaucuga

SEQ ID NO: 190779 - RNA, 1701 nt, Artificial Sequence; identical to SEQ ID NO: 190006
  derived and/or modified sequence opt5 from hemagglutinin__InfluenzaA__AER08668

SEQ ID NO: 190780 - RNA, 1701 nt, Artificial Sequence
  derived and/or modified sequence opt5 from hemagglutinin__InfluenzaA__AER08670
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugaaguccgaugcucccaucggaaaguguaauucugccugcauuaccccgaacggcagcaucccuaaugacaaacccuuucagaacgucaaucggauuacauacggcgcguguccucgcuauguuaagcaaaacacgcugaaacuugccaccgggaugagaaaugugcccgaaaagcagacacggggaaucuucggcgcuauugccggguuuaucgagaacggaugggaaggcaugguggacgggugguacggauuccgccaccagaauagcgagggcagaggccaagcugccgaucugaaaucuacccaggccgcuaucgaccagauuaacgggaagcucaaccggcugaucggaaaaacaaaugagaaguuccaucagauugaaaaggaguuuagcgaagucgagggcagaauccaagaucuugaaaaauauguggaggacaccaagauugaucugugguccuacaacgcggagcuccugguugcccuggaaaaucagcacacgaucgaccucacagauagcgagaugaacaaacuguucgaaaagaccaaaaagcagcuucgcgagaaugcugaagacauggggaacggaugcuuuaagauuuaucauaaaugugauaaugccugcaucggcucuauccggaacgggaccuacgaccacgauguguauagagacgaggcccugaauaaccgcuuccagauuaagggcgucgagcucaaauccggauacaaggacuggauccuguggauuagcuuugcuaucucuugcuuccuucuguguguggcccuccugggcuuuauuaugugggcgugccaaaaagggaauauccgguguaacaucugcauuuga

SEQ ID NO: 190781 - RNA, 1701 nt, Artificial Sequence
  derived and/or modified sequence opt5 from hemagglutinin__InfluenzaA__AER08672
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggaggcaauuguacccugauugacgcccuccugggggauccccagugcgacggauuucaaaacaaaaagugggaucuguucgucgagagaagcaaagccuauuccaauuguuacccuuaugacgugcccgauuacgcuucucuccggagccugguugccuccagcggcacgcuugaauuuaacucugaguccuucaauuggaccggcgugacacagaacgggaccagcucugcuugcauccgcagauccaauaacagcuuuuucucucggcugaauuggcucacacaucugaacuuuaaguauccugcccuuaaugucaccaugcccaacaacgaacaguucgacaagcuguacauuuggggagugcaccauccuggcacggauaaagaccagaucuuucucuaugcgcaagccuccgggcgcauuacaguuagcaccaagagaucccagcaggcugugaucccgaauauuggaucucggccccgcgucagaaacaucccuagccggaucuccauuuacuggacaaucgugaaacccggcgauauucugcugaucaauagcaccgggaaccucauugccccucgcggauacuucaagaucagaucuggcaaauccagcaucaugcggucugacgcucccauuggcaaguguaauagcgagugcaucaccccgaacggguccauuccuaaugacaagcccuuucagaacgugaaucgcaucacauauggagccuguccuagauacgucaaacaaucuacgcugaaacuugcgaccggcaugcggaacguucccgagaagcagacacgcgggauuuucggagccaucgcuggcuuuaucgaaaaugggugggagggaaugguggauggcugguauggcuucagacaccagaacagcgaagggcggggacaagccgcugaccugaaguccacccaggccgccauugaucagaucaauggcaaacucaacagacugauugggaagacaaaugagaaauuccaccagaucgagaaggaauuuagcgagguggaaggacgcauucaagaccuugagaaguacgucgaagauaccaaaaucgaccuguggucuuauaacgcugagcuccugguggcgcuggagaaccagcauacgauugaucucacagacuccgaaaugaauaagcuguucgagaaaaccaagaaacagcuucgggaaaacgccgaggauaugggcaaugggugcuuuaagaucuaccacaagugugacaacgcuugcaucggcagcauuagaaauggaaccuaugaucaugacguuuaccgcgacgaagcccugaacaaucgguuccagaucaaaggcguggagcucaagucuggguacaaagauuggauucuguggaucuccuuugccauuagcugcuuccuucugugugucgcucuccugggauuuaucaugugggccugccaaaagggcaacaucagauguaauauuugcaucuga

SEQ ID NO: 190782 - RNA, 1701 nt, Artificial Sequence
  derived and/or modified sequence opt5 from hemagglutinin__InfluenzaA__AER08674
augaagaccaucauugcccugagcuacauccucugccugguguucgcucagaaacuucccggcaacgacaauuccacagccacgcugugucucgggcaccaugcggucccuaacggaaccaugguuaagacaauuaccaaugaucaaaucgaggugacaaacgcuaccgaacuggugcagucuagcuccacaggcgagauuugcaauucuccgcaccagauccuugacggggaaaacuguacccugaucgaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauucgcagaucuaauaacuccuuuuucagccggcugaauuggcucacacaccugaacuuuaaguacccugcccuuaacgucaccaugcccaauaacgagcaguucgauaagcuguauaucuggggcgugcaucacccugggacggacaaagaucagauuuuucucuacgcgcaagccucuggacgcaucacaguuuccaccaagagaagccagcaggcugugauuccgaauaucggcucccggccccgcgucagaaacauuccuucucgggugagcaucuauuggacaaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucaccccgaacggcagcauuccuaaugacaagcccuuucagaacgucaaucgcaucacauacggcgcguguccuagauauguuaaacaaaacacgcugaaacuugccaccgggaugcggaaugugcccgaaaaacagacacgcggaauuuucggcgcuaucgccggguuuauugagaacggaugggaaggcaugguggacgggugguacggauucagacaccaaaauuccgagggccggggccaggcugccgaucugaagucuacccaggccgcuaucgaccagaucaacgggaaacucaacagacugauuggaaagacaaaugagaaauuccaucagaucgaaaaggaguuuagcgaagucgagggccgcauucaagaucuugaaaaguauguggaggacaccaaaaucgaucugugguccuacaacgcggagcuccugguugcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcauuggcucuaucagaaacgggaccuacgaccacgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauauuagauguaacaucugcaucuga

SEQ ID NO: 190783 - RNA, 1701 nt, Artificial Sequence; identical to SEQ ID NO: 190006
  derived and/or modified sequence opt5 from hemagglutinin__InfluenzaA__AER08676

SEQ ID NO: 190784 - RNA, 1701 nt, Artificial Sequence; identical to SEQ ID NO: 190006
  derived and/or modified sequence opt5 from hemagglutinin__InfluenzaA__AER08678

SEQ ID NO: 190785 - RNA, 1701 nt, Artificial Sequence
  derived and/or modified sequence opt5 from hemagglutinin__InfluenzaA__AER08680
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcucauuccaauuguuauccuuacgacgugcccgauuaugccucucuccgcagccugguugcuuccagcgggacccuugaauuuaacaaugagucuuucaacuggacgggagugacccagaauggcacauccagcgccugcaucagacggucuaacaauuccuuuuucagccgccugaacuggcucacccaccugaauuuuaaauacccugcgcuuaacgucacaaugcccaacaaugagcaguucgacaagcuguauauuuggggcgugcaucacccugggaccgauaaggaccagaucuuucucuacgcccaggcuucuggaagaauuacgguuuccacaaaacggagccagcaggccgugaucccgaacauuggcucccgccccagaguccggaauaucccuucucgcaucagcauuuauuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuacggcgcguguccucgguaugucaagcaauccacacugaaacuugccacggggaugcgcaauguucccgagaagcagaccagaggaauuuucggcgcuaucgccggguuuaucgaaaacggaugggagggcaugauggaugggugguacggauuccggcaccaaaauucugagggcagaggccaagcugccgaccugaaaagcacacaggccgcuauugaucagaucaacgggaagcucaaucgccugauuggaaaaaccaacgaaaaguuccaucagaucgagaaagaauuuuccgagguggaaggccggauucaagaccuugagaaguauguggaggauacaaagaucgaccuguggagcuacaacgcggaacuccuggucgcccuggagaaucagcacaccauugaucucacggacucugaaaugaacaaacuguucgagaagaccaaaaagcagcuuagagaaaaugcugaggauauggggaacggaugcuuuaaaaucuaucauaagugugacaaugccugcaucggcuccauucgcaacgggacauacgaucacgacguguaucgggacgaggcccugaauaacagauuccagaucaagggcguugaacucaaaagcggauacaaggauuggauucuguggaucucuuuugcuauuuccugcuuccuucuguguguggcccuccugggcuuuaucaugugggcgugccaaaaagggaauauccgcuguaacauuugcaucuga

SEQ ID NO: 190786 - RNA, 1701 nt, Artificial Sequence
  derived and/or modified sequence opt5 from hemagglutinin__InfluenzaA__AER08682
augaagaccgugaucgcccugagcuacauucucugccuggucuucgcucagaaacuucccggcaacgacaauuccacagccacgcugugucucgggcaccaugcgguuccuaacggaaccaucgugaagacaauuaccaaugaucaaaucgaggugacaaacgcuaccgaacugguccagucuagcuccacaggcgagauuugcaauucuccgcaccagauccuugacggggaaaacuguacccugaucgaugcccuccugggagacccccagugcgauggcuuucaaaauaaaaagugggaccuguucguggagagaagcaaagcccauuccaacuguuauccuuacgauguucccgacuaugcuucucuccggagccugguggccuccagcgggacgcuugaauuuaauaacgagucuuucaauuggaccggagucacacagaacggcaccuccagcgcuugcauucgcagaucuaauaacuccuuuuucagccggcugaauuggcucacacaccugaacuuuaaguacccugcccuuaacgugaccaugcccaauaacgagcaguucgauaagcuguauaucuggggcguucaucacccugggacggacaaagaucagauuuuucucuacgcgcaagccucuggacgcaucacaguguccaccaagagaagccagcaggcugucauuccgaauaucggcucccggccccgcgugagaaacauuccuucucgggugagcaucuauuggacaaucgucaaacccggggacauucugcugaucaauuccaccggaaaccucauugccccucgcggcuacuucaagaucagaagcgggaaaucuuccauuaugcggagcgaugcucccaucggaaaguguaauucugccugcaucaccccgaacggcagcauuccuaaugacaagcccuuucagaacguuaaucgcaucacauacggcgcguguccuagauaugugaaacaaaacacgcugaaacuugccaccgggaugcggaaugugcccgaaaaacagacacgcggaauuuucggcgcuaucgccggguuuauugagaacggaugggaaggcauggucgacgggugguacggauucagacaccaaaauuccgagggccggggccaggcugccgaucugaagucuacccaggccgcuaucgaccagaucaacgggaaacucaacagacugauuggaaagacaaaugagaaauuccaucagaucgaaaaggaguuuagcgaaguggagggccgcauucaagaucuugaaaaguauguugaggacaccaaaaucgaucugugguccuacaacgcggagcuccugguggcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcauuggcucuaucagaaacgggaccuacgaccacgaugucuaucgcgacgaggcccugaauaaccgguuccagaucaaaggcguggagcucaaguccggauacaaagacuggauucuguggaucagcuuugcuauuucuugcuuccuucuguguguugcccuccugggcuuuaucaugugggcgugccaaaaggggaauauuagauguaacaucugcaucuga

SEQ ID NO: 190787 - RNA, 1701 nt, Artificial Sequence
  derived and/or modified sequence opt5 from hemagglutinin__InfluenzaA__AER08684
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucuaccugcauuacaccgaacggcagcaucccuaaugacaagcccuuucagaacgucaaucgcauuacguacggcgccuguccuagauauguuaaacaaaacacccugaaacuugcgacagggaugcggaaugugcccgaaaaacagacccgcggaaucuucggcgccauugcuggguuuaucgagaacggaugggaaggcaugguggacgggugguacggauucagacaccaaaauuccgagggccggggccaggccgcugaucugaagucuacacaggccgccaucgaccagauuaacgggaaacucaacagacugaucggaaagaccaaugagaaauuccaucagauugaaaaggaguuuagcgaagucgagggccgcauccaagaucuugaaaaguauguggaggacacgaaaauugaucugugguccuacaacgcugagcuccugguugcgcuggaaaaucagcacacaaucgaccucaccgauagcgagaugaacaagcuguucgaaaagaccaagaaacagcuucgggagaaugccgaagacauggggaacggaugcuuuaagauuuaucauaagugugauaaugcuugcaucggcucuaucagaaacgggacauacgaccacgauguguaucgcgacgaggcccugaauaaccgguuccagauuaaaggcgucgagcucaaguccggauacaaagacuggauccuguggauuagcuuugccaucucuugcuuccuucuguguguggcucuccugggcuuuauuaugugggccugccaaaaggggaauaucagauguaacaucugcauuuga

SEQ ID NO: 190788 - RNA, 1701 nt, Artificial Sequence
  derived and/or modified sequence opt5 from hemagglutinin__InfluenzaA__AER08686
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucuaccugcauuacaccgaacggcagcaucccuaaugacaagcccuuucagaacgucaaucgcauuacguacggcgccuguccuagauauguuaaacaaaacacccugaaacuugcgacagggaugcggaaugugcccgaaaaacagacccgcggaaucuucggcgccauugcuggguuuaucgagaacggaugggaaggcaugguggacgggugguacggauucagacaccaaaauuccgagggccggggccaggccgcugaucugaagucuacacaggccgccaucgaccagauuaacgggaaacucaacagacugaucggaaagaccaaugagaaauuccaucagauugaaaaggaguuuagcgaagucgagggccgcauccaagaucuugaaaaguauauugaggacacgaaaaucgaucugugguccuacaacgcugagcuccugguggcgcuggaaaaucagcacacaauugaccucaccgauagcgagaugaacaagcuguucgaaaagaccaagaaacagcuucgggagaaugccgaagacauggggaacggaugcuuuaagaucuaucauaagugugauaaugcuugcaucggcucuauuagaaacgggacauacgaccacgauguuuaucgcgacgaggcccugaauaaccgguuccagaucaaaggcguggagcucaaguccggauacaaagacuggauucuguggaucagcuuugccauuucuugcuuccuucugugugucgcucuccugggcuuuaucaugugggccugccaaaaggggaauaucagauguaacauuugcaucuga

SEQ ID NO: 190789 - RNA, 1701 nt, Artificial Sequence; identical to SEQ ID NO: 190006
  derived and/or modified sequence opt5 from hemagglutinin__InfluenzaA__AER08688

SEQ ID NO: 190790 - RNA, 1701 nt, Artificial Sequence
  derived and/or modified sequence opt5 from hemagglutinin__InfluenzaA__AER08690
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcaauucuccgcaccagauccuugacggcgagaacuguacccugauugaugcccuccugggggacccccagugcgauggauuucaaaauaaaaagugggaccuguucgucgaaagaagcaaagcccauuccaacuguuauccuuacgaugugcccgacuaugcuucucuccggagccugguugccuccagcggcacgcuugaguuuaauaacgagucuuucaauuggaccggggugacacagaacggaaccuccagcgcuugcauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccuggcacggacaaagaucagaucuuucucuacgcgcaagccucugggcgcauuacaguuuccaccaagagaagccagcaggcugugaucccgaauauuggaucccggccccgcgucagaaacaucccuucucgggugagcaucuauuggacaauugugaaacccggcgacauccugcugauuaauuccaccgggaaccucaucgccccucgcggauacuucaagauuagaagcggcaaaucuuccaucaugcggagcgaugcucccaucgggaaguguaauucuaccugcauuacaccgaacggaagcaucccuaaugacaagcccuuucagaacgucaaucgcauuacguacggcgccuguccuagauauguuaaacaaaacacccugaaacuugcgacaggcaugcggaaugugcccgagaagcagacccgcgggaucuucggagccauugcuggcuuuaucgaaaacgggugggagggaaugguggacggcugguacggguucagacaccaaaauuccgagggacggggccaggccgcugaucugaagucuacacaggccgccaucgaccagauuaacggcaaacucaacagacugaucgggaagaccaaugaaaaauuccaucagauugagaaggaauuuagcgaggucgaaggacgcauccaagaucuugagaaguauguggaggacacgaaaauugaucugugguccuacaacgcugaacuccugguugcgcuggagaaucagcacacaaucgaccucaccgauagcgaaaugaacaagcuguucgagaaaaccaagaaacagcuucgggaaaaugccgaggacaugggcaacgggugcuuuaagauuuaucauaagugugauaaugcuugcaucggaucuaucagaaacggcacauacgaccacgauguguaucgcgacgaggcccugaauaaccgguuccagauuaaaggggucgaacucaaguccggcuacaaagacuggauccuguggauuagcuuugccaucucuugcuuccuucugugugugguucuccugggauuuauuaugugggcuugccaaaagggcaauaucagauguaacaucugcauuuga

SEQ ID NO: 190791 - RNA, 1701 nt, Artificial Sequence; identical to SEQ ID NO: 190006
  derived and/or modified sequence opt5 from hemagglutinin__InfluenzaA__AER08692

SEQ ID NO: 190792 - RNA, 1701 nt, Artificial Sequence
  derived and/or modified sequence opt5 from hemagglutinin__InfluenzaA__AER08698
augaagaccacaaucgcccugagccacauucucugccugguguucgcucagaaacuucccggcaacgacaauuccacggccacccugugucucgggcaucacgcggucccuaacggaacaaucguuaagaccauuacaaaugaucaaaucgaggugaccaacgcuacagaacuggugcagucuagcuccgccggcgagauuugcgacucuccgcaucagauccuugauggggaaaauuguacccugaucgacgcccuccugggagauccccagugcgacggcuuucaaaacaaaaagugggaucuguucgucgagagaagccgggcuuacuccaauuguuauccuuacgacgugcccgauuaugccucucuccgcagccugguugcuuccagcgggacgcuugaauuuaacaaugagucuuucaacuggaccggagugacacagaauggcaccuccagcgccugcauuagacggucuaacaauuccuuuuucagccgccugaacuggcucacacaccugaauuuuaaauacccugcgcuuaacgucaccaugcccaacaaugagcaguucgacaagcuguauaucuggggcgugcaucacccugggacggauaaggaccagauuuuucucuacgcccaggcuucuggaagaaucacaguuuccaccaaacggagccagcaggccgugauuccgaacaucggcucccgccccagaguccggaauauuccuucucgcaucagcaucuauuggacaauugugaagcccggggauauccugcugauuaacuccaccggaaaucucaucgcuccuagaggcuacuucaaaauucggagcgggaagucuuccaucaugcgcagcgacgcccccaucggaaaauguaacucugaaugcauuaccccgaauggcagcaucccuaacgacaagcccuuucagaaugugaacagaauuacauacggcgcguguccucgguaugucaagcaauccacgcugaaacuugccaccgggaugcgcaauguucccgagaagcagacaagaggaaucuucggcgcuauugccggguuuaucgaaaacggaugggagggcaugguggaugggugguacggauuccggcaccaaaauucugagggcagaggccaagcugccgaccugaaaagcacccaggccgcuaucgaucagauuaacgggaagcucaaucgccugaucggaaaaacaaacgaaaaguuccaucagauugagaaagaauuuuccgagguggaaggccggauccaagaccuugagaaguaugucgaggauaccaagauugaccuguggagcuacaacgcggaacuccugguggcccuggagaaucagcacacgaucgaucucacagacucugaaaugaacaaacuguucgagaagaccaaaaagcagcuuagagaaaaugcugaggauauggggaacggaugcuuuaaaauuuaucauaagugugacaaugccugcaucggcuccauccgcaacgggaccuacgaucacgacguuuaucgggacgaggcccugaauaacagauuccagauuaagggcguggaacucaaaagcggauacaaggauuggauccuguggauuucuuuugcuaucuccugcuuccuucugugugucgcccuccugggcuuuauuaugugggcgugccaaaaagggaauauccgcuguaacaucugcauuuga

SEQ ID NO: 190793 - RNA, 1701 nt, Artificial Sequence; identical to SEQ ID NO: 190006
  derived and/or modified sequence opt5 from hemagglutinin__InfluenzaA__AER08700

SEQ ID NO: 190794 - RNA, 1701 nt, Artificial Sequence
  derived and/or modified sequence opt5 from hemagglutinin__InfluenzaA__AER92712
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccaauucugauaacggcacgugcuauccgggggacuuuauugauuacgaagaacugcgggagcagcuuagcuccgucagcucuuucgaacgcuuugagaucuuccccaagaccuccagcuggccuaaucacgacucuaacaagggagugacagccgcuuguccccaugccggcgcgaaauccuuuuauaagaaucugaucuggcucguuaaaaagggcaacagcuacccuaaacugaauaagucuuauauuaacgauaaggggaaagaagugcuuguccuguggggaauccaccaccccuccaccagcacagaccaacagucccucuaccagaaugccgaugcuuacguguucgugggcaccucuagauauagcaagaaauuuaagccugagauugccauccggccgaaaguccgcaaccaggaggggagaaugaacuacuauuggacgcugguugaacccggagacaagauuacauucgaggcuaccggcaaucugguggugccucgguacgccuuuacaaucgaacgcaacgcgggguccggaauuaucaucagcgauacccccauucaugacugcaauaccacaugucaaacgccuaaaggcgccaucaacaccucucuccccuuccagaauauucacccgaucacaauuggcaagugcccuaaguaugucaaauccaccaagcugagacuugcuacagggcugcggaacgugcccagcauccagucucgcggacucuuuggcgccaucgcuggguucauugagggaggcuggaccgggaugguugacggaugguacggcuaucaucaccagaaugaacaaggcagcggguacgccgccgaucugaaauccacgcagaacgcuaucgacgagauuacaaauaaggugaacucugucaucgagaaaaugaauacccaguuuaccgcggugggaaaggaguucaaccaccuugagaagagaauugaaaaucugaacaaaaagguugaugacggcuuccucgauaucuggacauacaaugccgagcugcuggugcuccuggaaaacgagcggacccuugacuaucaugauagcaacgucaaaaaucuguacgagaaggugcgcucccagcucaaaaacaaugcuaaggaaaucgggaacggauguuuugaguucuaucacaagugcgacaauacauguauggaaagcgucaaaaacggcacguacgauuauccuaaguacucugaggaagccaaacugaauagagaggagauugacggggugaaacuugaauccacccggaucuaucaaauucuggccaucuacagcacaguugcuucuucccucgugcuggucgugagccugggcgccauuuccuuuuggaugugcucuaacggaagccuccagugccgcaucuguauuuga

SEQ ID NO: 190795 - RNA, 1701 nt, Artificial Sequence; identical to SEQ ID NO: 188557
  derived and/or modified sequence opt5 from hemagglutinin__InfluenzaA__AET10090

SEQ ID NO: 190796 - RNA, 1701 nt, Artificial Sequence; identical to SEQ ID NO: 188557
  derived and/or modified sequence opt5 from hemagglutinin__InfluenzaA__AET10091

SEQ ID NO: 190797 - RNA, 1701 nt, Artificial Sequence; identical to SEQ ID NO: 188557
  derived and/or modified sequence opt5 from hemagglutinin__InfluenzaA__AET10092

SEQ ID NO: 190798 - RNA, 1701 nt, Artificial Sequence
  derived and/or modified sequence opt5 from hemagglutinin__InfluenzaA__AET10094
augaagaccaucauugcccugagcugcauccucugucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucgucgagagaagcaaagccuacuccucuugcuauccuuacgacgugcccgauuaugcuagccuccggucccugguugccagcucugggacgcuugaauuuaauaacgaguccuucaauuggaccggagugacacagaacggcaccagcucugcuuguauccgcagauccaauaacagcuuuuucucucggcugaauuggcucacacaucugaacuuuaaguacccugcccuuaaugucaccaugcccaacaacgagcaguucgacaagcuguauauuuggggcgugcaccauccugggacggauaaagaccagaucuuucucuacgcgcaagccuccggacgcauuacaguuagcaccaagagaucccagcaggcugugaucccgaauauuggcucucggccccgcgucagaaacaucccuagccggaucuccauuuauuggacaaucgugaaacccggggauauucugcugaucaauagcaccggaaaccucauugccccucgcggcuacuucaagaucagaucugggaaauccagcaucaugcggucugacgcucccauuggaaagugcaauagcgaauguaucaccccgaacggcuccauuccuaaugacaagcccuuucagaacgugaaucgcaucacauacggcgccugcccuagauaugucaaacaaucuacgcugaaacuugcgaccgggaugcggaacguucccgagaagcagacacgcggaauuuucggcgccaucgcuggguuuaucgaaaauggaugggagggcaugguggaugggugguacggauucagacaccagaacagcgagggccggggccaagccgcugaccugaaguccacccaggccgccauugaucagaucaaugggaaacucaacagacugauuggaaagacaaaugaaaaauuccaccagaucgagaaggaauuuagcgagguggaaggccgcauucaagaccuugagaaguaugucgaggauaccaaaaucgaccuguggucuuacaacgcugaacuccugguggcgcuggagaaccagcauacgauugaucucacagacuccgaaaugaauaagcuguucgagaaaaccaagaaacagcuucgggaaaacgccgaggauauggggaauggauguuuuaccaucuaucacaagugcgacaacgcuugcaucggcagcauuagaaaugggacauacgaucauaacguuuaucgcgacgaggcccugaauaaccgguuccagaucaagggcguggaacucaaaucuggauacaaggacuggauucuguggaucuccuuugccauuagcuguuuccuucugugcgucgcucuccugggcuuuaucaugugggccugucaaaaagggaauaucagaugcaacauuuguaucuga

SEQ ID NO: 190799 - RNA, 1701 nt, Artificial Sequence
  derived and/or modified sequence opt5 from hemagglutinin__InfluenzaA__AET10095
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacacccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucgagucuauuagaaauggcacauaugaucaugacguuuaccgcgacgaagcucugaacaaucgguuccagaucaaagggguggagcucaaguccggcuacaaagauuggauucuguggaucagcuuugccauuucuugcuuccuucugugugucgcccuccugggauuuaucaugugggcuugccaaaagggcaacaucagauguaauauuugcaucuga

SEQ ID NO: 190800 - RNA, 1701 nt, Artificial Sequence
  derived and/or modified sequence opt5 from hemagglutinin__InfluenzaA__AET10096
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcaaaauucuagcacaggcgagaucugcgacuccccgcaccagaucauugauggggaaaacuguacccugaucgacgcccuucugggagauccccagugcgacggcuuccagaauaaaaaguggaaccucuuugucgagagaucuaaagccuauagcaauuguuacccuuaugaugugcccgacuacgcuucccugcggucucugguugccagcuccgggacgcucgaauuuaacaaugagagcuucaacuggaccggagugacacagaauggcaccucuuccgcuugcauucgcagaagcaacaauucuuucuuuucccggcugaacuggcuuacacaucugaacuucaaguauccugcccucaaugucaccaugcccaacaaugagcaguuugauaagcuguacaucuggggcgugcaccauccugggacggacaaagaucagauuuuccuuuaugcgcaagccagcggacgcaucacaguuucuaccaagagaucccagcaggcugugauuccgaacaucggcagccggccccgcgucagaaauaucccuucccggauuucuaucuacuggacaauugugaaacccggggacauccugcucauuaacagcaccggaaaucugaucgccccucgcggcuacuuuaagaucagauccgggaaaagcucuauuaugcgguccgaugcucccaucggaaaguguaacagcgaaugcauuaccccgaauggcucuaucccuaacgacaagcccuuccagaaugugaaccgcauuacauauggcgccuguccuagauacgucaaacaaaauacgcugaagcucgcgaccgggaugcggaacguucccgagaaacagacacgcggaaucuuuggcgccaucgcuggguucauugaaaauggaugggagggcaugguggacgggugguauggauucagacaccagaacagcgagggccggggccaagccgcugaucugaaguccacccaggccgccaucgaccagauuaacgggaaacuuaauagacugaucggaaagacaaacgaaaaauuucaccagauugagaaggaguucucugaaguggaaggccgcauccaagaucucgagaaguacgucgaggacaccaaaauugaucuguggagcuauaaugcugaacuucugguggcgcucgagaaccagcauacgaucgaccugacagauuccgaaaugaauaagcuguuugagaaaaccaagaaacagcuccgggaaaacgccgaggacauggggaauggaugcuucaagaucuaccacaagugugauaacgcuugcauuggcagcaucagaaaugggaccuaugaccaugauguuuaccgcgacgaggcccugaacaaucgguuucagauuaaaggcguggaacuuaagucuggauacaaagacuggauccuguggauuuccuucgccaucagcugcuuucuccugugugucgcccuucugggcuucaucaugugggcuugccaaaaggggaacauuagauguaauaucugcauuuga

SEQ ID NO: 190801 - RNA, 1701 nt, Artificial Sequence
  derived and/or modified sequence opt5 from hemagglutinin__InfluenzaA__AET10098
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcaaaauucuagcacaggcgagaucugcgacuccccgcaccagaucauugauggggaaaacuguacccugaucgacgcccuucugggagauccccagugcgacggcuuccagaauaaaaagugggaucucuuugucgagagaucuaaagccuauagcaacuguuacccuuaugacgugcccgauuacgcuucccugcggucucugguugccagcuccgggacgcucgaauuuaauaacgagagcuucaauuggaccggagugacacagaacggcaccucuuccgcuugcauucgcagaagcaauaacucuuucuuuucccggcugaauuggcuuacacaucugaacuucaaguauccugcccucaacgucaccaugcccaauaacgagcaguuugacaagcuguacaucuggggcgugcaccauccugggacggauaaagaccagauuuuccuuuaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccugcucauuaauagcaccggaaaccugaucgccccucgcggcuacuuuaagaucagauccgggaaaagcucuauuaugcgguccgacgcucccaucggaaaguguaauagcgaaugcauuaccccgaacggcucuaucccuaaugacaagcccuuccagaacgugaaucgcauuacauauggcgccuguccuagauacgucaaacaaaacacgcugaagcucgcgaccgggaugcggaauguucccgagaaacagacacgcggaaucuuuggcgccaucgcuggguucauugaaaacggaugggagggcaugguggaugggugguauggauucagacaccagaauagcgagggccggggccaagccgcugaccugaaguccacccaggccgccaucgaucagauuaacgggaaacuuaacagacugaucggaaagacaaaugaaaaauuucaccagauugagaaggaguucucugaaguggaaggccgcauccaagaccucgagaaguacgucgaggauaccaaaauugaccuguggagcuauaacgcugaacuucugguggcgcucgagaaucagcauacgaucgaucugacagacuccgaaaugaacaagcuguuugagaaaaccaagaaacagcuccgggaaaaugccgaggauauggggaacggaugcuucaagaucuaccacaagugugacaaugcuugcauuggcagcaucagaaacgggaccuaugaucaugacguuuaccgcgacgaggcccugaauaaccgguuucagauuaaaggcguggaacuuaagucuggauacaaagauuggauccuguggauuuccuucgccaucagcugcuuucuccugugugucgcccuucugggcuucaucaugugggcuugccaaaaggggaauauuagauguaacaucugcauuuga

SEQ ID NO: 190802 - RNA, 1701 nt, Artificial Sequence; identical to SEQ ID NO: 189879
  derived and/or modified sequence opt5 from hemagglutinin__InfluenzaA__AET10099

SEQ ID NO: 190803 - RNA, 1701 nt, Artificial Sequence; identical to SEQ ID NO: 190006
  derived and/or modified sequence opt5 from hemagglutinin__InfluenzaA__AET10100

SEQ ID NO: 190804 - RNA, 1701 nt, Artificial Sequence
  derived and/or modified sequence opt5 from hemagglutinin__InfluenzaA__AET10101
augaagaccaucauugcccugagcugcauccucugucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucgucgagagaagcaaagccuacuccaauugcuauccuuacgacgugcccgauuaugcuucucuccggagccugguugccuccagcgggacgcuugaauuuaacaaugagucuuucaacuggaccggagugacacagaauggcaccuccagcgcuuguauccgcagaucuaacaauuccuuuuucagccggcugaacuggcucacacaucugaauuuuaaguacccugcccuuaacgucaccaugcccaacaaugagcaguucgacaagcuguauauuuggggcgugcaccauccuggggcggauaaagaccagaucuuucucuacgcccaggcuucuggacgcauuacgguuuccacaaagagaagccagcaggccgugaucccgaacauuggcucccggccccgcgucagaaauaucccuucucggaucagcauuuauuggaccaucgugaaacccggggauauucugcugaucaacuccacaggaaaucucauugcuccucgcggcuacuucaagaucagaagcgggaaaucuuccaucaugcggagcgacgcccccauuggaaagugcaacucugaauguaucaccccgaauggcagcauuccuaacgacaagcccuuucagaaugugaaccgcaucaccuacggcgcgugcccuagauaugucaaacaauccacacugaagcuggccacggggaugcggaauguucccgagaaacagacccgcggaauuuucggcgcuaucgccggguuuaucgaaaacggaugggagggcaugguggaugggugguacggauucagacaccaaaauucugagggccggggccaagcugccgaccuuaagagcacacaggccgcuauugaucagaucaacgggaaacucaauagacugauuggaaagaccaacgaaaaauuccaccagaucgagaaggaauuuuccgagguggaaggccgcauucaagaccuugagaaguaugucgaggauacaaaaaucgaccuguggagcuacaacgcggaacuccugguggcccuggagaaucagcauaccauugaucucacggacucugaaaugaacaagcuguucgagaaaacaaagaaacagcuucgggaaaaugcugaggauauggggaacggauguuuuaccaucuaucacaagugcgacaaugccugcaucggcuccauuagaaacgggaccuacgaucauaauguuuaucgcgacgaggcccugaacaaucgguuccagaucaagggcguggaacucaaaagcggauacaaggacuggauucuguggaucucuuuugcuauuuccuguuuccuucugugcgucgcccuccugggcuuuaucaugugggcgugucaaaaagggaacaucagaugcaauauuuguaucuga

SEQ ID NO: 190805 - RNA, 1701 nt, Artificial Sequence
  derived and/or modified sequence opt5 from hemagglutinin__InfluenzaA__AET10102
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugaugggaaaaauuguacgcugauugacgcucuccugggagauccccagugcgacggcuuucaaaacaagaaaugggaucuguucgucgaaagaagcaaggccuauuccaauuguuacccuuuugacgugcccgauuaugccucucuccggagccugguugcuuccagcgggacccuugaguucaacaaugaaucuuuuaacuggacaggagugacccagaauggcacauccagcgccugcaugcgcagaucuaaguccagcuucuuuucucggcugaacuggcucacccaucugaauuucaaauacccugcucuuaacgucacgaugcccaaugacgagcaguuugauaagcuguauaucuggggcgugcaccauccugggacagacaaagaucagauuuuccucuacgcccaagcguccggacgcaucaccguuagcacaaagagaucccagcagaccgugauuccgaacaucggcucucggccccgcauuagaaacaucccuagccggaucuccauuuauuggaccaucgucaaacccggggacauucugcugaucaauagcacaggaaaccucauugccccucgcggcuacuuuaagaucagaucugggaaguccagcaucaugcggucugacgcucccauuggaaaauguaauagcgagugcaucacgccgaacggcuccauuccuaaugauaagcccuuccagaacgugaaucgcaucaccuacggcgccuguccuagauaugugaaacaaaacacacugaagcuggcuaccgggaugcggaauguccccgaaaaacagacacgcggaauuuuuggcgccaucgcgggguucaucgagaacggaugggaaggcaugguugacgggugguacggauucagacaccaaaauucugagggccggggccaggccgcugaucuuaagagcacccaggccgcuauugaccagaucaacgggaaacucaauagacugauuggacgcacgaacgagaaguuucaccagaucgaaaaggaguucuccgaaguggagggccggauucaagaucuugaaaaauauguggaggacacaaagaucgaucuguggagcuacaaugccgagcuccuggucgcccuggaaaaccagcauaccauugaccucaccgauucugagaugaacaaacuguuugaaaagacaagaaaacagcuucgcgagaaugcugaagacauggggaacggaugcuucaagaucuaucacaagugugauaaugcgugcaucggcuccauucggaacgggaccuacgaccaugacguguauagagaugaggcccugaauaaccgcuuucagaucaaaggcguugagcucaagagcggauacaaagacuggauucuguggaucucuuucgcuauuuccugcuuucuucuguguguggccagccucggcuucaucaugugggccugccaaaaggggaauauccgguguaacauuugcaucuga

SEQ ID NO: 190806 - RNA, 1701 nt, Artificial Sequence
  derived and/or modified sequence opt5 from hemagglutinin__InfluenzaA__AET10103
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauauuggcagccggccccgcgucagaaacaucccuucccggaucucuauuuacuggacaaucgugaaacccggggauauucugcugaucaauagcaccggaaaccucauugccccucgcggcuacuucaagaucagauccgggaaaagcucuaucaugcgguccgacgcucccauuggaaaguguaauagcgaaugcaucaccccgaacggcucuauuccuaaugacaagcccuuucagaacgugaaucgcaucacauauggcgccuguccuagauacgucaaacaaaacacgcugaaacuugcgaccgggaugcggaauguucccgagaagcagacacgcggaauuuucggcgccaucgcuggguuuaucgaaaacggaugggagggcaugguggaugggugguauggauucagacaccagaauagcgagggccggggccaagccgcugaccugaaguccacccaggccgccauugaucagaucaacgggaaacucaacagacugauuggaaagacaaaugaaaaauuccaccagaucgagaaggaauuuucugagguggaaggccgcauucaagaccuugagaaguacgucgaggauaccaaaaucgaccuguggagcuauaacgcugaacuccugguggcgcuggagaaucagcauacgauugaucucacagacuccgaaaugaacaagcuguucgagaaaaccaagaaacagcuucgggaaaaugccgaggauauggggaacggaugcuuuaagaucuaccacaagugugacaaugcuugcaucggcagcauuagaaacgggaccuaugaucaugacguuuaccgcgacgaggcccugaauaaccgguuccagaucaaaggcguggaacucaagucuggauacaaagauuggauucuguggaucuccuuugccauuagcugcuuccuucugugugucgcucuccugggcuuuaucaugugggccugccaaaaggggaauaucagauguaacauuugcaucuga

SEQ ID NO: 190807 - RNA, 1701 nt, Artificial Sequence
  derived and/or modified sequence opt5 from hemagglutinin__InfluenzaA__AET10104
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcaaaauucuagcacaggcgagaucugcgacuccccgcaccagaucauugauggggaaaacuguacccugaucgacgcccuucugggagauccccagugcgacggcuuccagaauaaaaagugggaucucuuugucgagagaucuaaagccuauagcaacuguuacccuuaugacgugcccgauuacgcuucccugcggucucugguugccagcuccgggacgcucgaauuuaauaacgagagcuucaauuggaccggagugacacagaacggcaccucuuccgcuugcauucgcagaagcaauaacucuuucuuuucccggcugaauuggcuuacacaucugaacuucaaguauccugcccucaacgucaccaugcccaauaacgagcaguuugacaagcuguacaucuggggcgugcaccauccugggacggauaaagaccagauuuuccuuuaugcgcaagccagcggacgcaucacaguuucuaccaagagaucccagcaggcugugauuccgaauaucggcagccggccccgcgucagaaacaucccuucccggauuucuaucuacuggacaauugugaaacccggggauauccugcucauuaauagcaccggaaaccugaucgccccucgcggcuacuuuaagaucagauccgggaaaagcucuauuaugcgguccgacgcucccaucggaaaguguaauagcgaaugcauuaccccgaacggcucuaucccuaaugacaagcccuuccagaacgugaaucgcauuacauauggcgccuguccuagauacgucaaacaaaacacgcugaagcucgcgaccgggaugcggaauguucccgagaaacagacacgcggaaucuuuggcgccaucgcuggguucauugaaaacggaugggagggcaugguggaugggugguauggauucagacaccagaauagcgagggccggggccaagccgcugaccugaaguccacccaggccgccaucgaucagauuaacgggaaacuuaacagacugaucggaaagacaaaugaaaaauuucaccagauugagaaggaguucucugaaguggaaggccgcauccaagaccucgggaaguacgucgaggauaccaaaauugaccuguggagcuauaacgcugagcuucugguggcgcucgaaaaucagcauacgaucgaucugacagacuccgagaugaacaagcuguuugagaaaaccaagaaacagcuccgggaaaaugccgaagauaugggaaacggcugcuucaagaucuaccacaagugugacaaugcuugcauugggagcaucagaaacggcaccuaugaucaugacguuuaccgcgacgaggcccugaauaaccgguuucagauuaaaggaguggagcuuaagucuggcuacaaagauuggauccuguggauuuccuucgccaucagcugcuuucuccugugugucgcccuucugggguucaucaugugggcuugccaaaagggaaauauuagauguaacaucugcauuuga

SEQ ID NO: 190808 - RNA, 1701 nt, Artificial Sequence
  derived and/or modified sequence opt5 from hemagglutinin__InfluenzaA__AET10105
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauacccugcccuuaacgucaccaugcccaauaacgaacaguucgauaagcuguauauuuggggcgugcaucacccugggacggacaaggaucagaucuuucucuacgcgcaagccgcuggacgcauuacaguuucuaccaaaagaucccagcaggccgugaucccgaauauuggcagccggccccgcgucagaaacaucccuucccgggugucuaucuauuggacaauugugaagcccggggacauccugcugauuaauagcaccggaaaccucaucgcuccucgcggcuacuucaaaauuagauccggaaagagcucuaucaugcgguccgaugcccccaucgggaaauguaauagcgcgugcauuaccccgaacggcucuaucccuaaugacaagcccuuucagaacgucaaucgcauuacauacggcgccuguccuagauauguuaagcaaaacacgcugaaacuugcuaccgggaugcggaaugugcccgagaagcagacacgcggaaucuucggcgccauugcuggguuuaucgaaaacggaugggagggcaugguggacgggugguacggauucagacaccagaauagcgagggccggggccaagccgccgaucugaaauccacccaggcugcgaucgaccagauuaacgggaagcucaacagacugaucggaaaaacaaaugaaaaguuccaucagauugagaaagaauuuucugaggucgaaggccgcauccaagaucuugagaaguauguggaggacaccaagauugaucuguggagcuacaacgccgaacuccugguugcucuggagaaucagcacacgaucgaccucacagauuccgaaaugaacaaacuguucgagaagaccaaaaagcagcuucgggaaaaugccgaggacauggggaacggaugcuuuaaaauuuaucauaagugugauaaugccugcaucggcagcaucagaaacgggaccuacgaccacgauguguaucgcgacgaggcucugaauaaccgguuccagauuaagggcgucgaacucaaaucuggauacaaggacuggauccuguggauuuccuuugccaucagcugcuuccuucuguguguggcgcuccugggcuuuauuaugugggcuugccaaaaagggaauaucagauguaacaucugcauuuga

SEQ ID NO: 190809 - RNA, 1701 nt, Artificial Sequence
  derived and/or modified sequence opt5 from hemagglutinin__InfluenzaA__AET10106
augaagaccaucauugcccugagcuacauccucugccugguguucgcucagaaacuucccggcaacuauaauuccacagccacgcugugucucgggcaccaugcggucccuaacggaaccauuguuaagacaaucaccaaugaccaaauugaggugacaaacgcuaccgaacuggugcagucuagcuccacaggcgagaucugcaauucuccgcaccagauccuugauggggaaaacuguacccugauugacgcccuccugggagauccccagugcgacggcuuucaaaauaaaaagugggaucuguucgucgagagaagcaaagcccauuccaacuguuacccuuaugacgugcccgauuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguauccugcccuuaacgucaccaugcccaauaacgagcaguucgacaagcuguacauuuggggcgugcaucacccugggacggauaaagaccagaucuuucucuaugcgcaagccucuggacgcauuacaguuuccaccaagagaagccagcaggcugugaucccgaauauuggcucccggccccgcgucagaaacaucccuucucgggugagcaucuacuggacaauugugaaacccggggauauccugcugauuaauuccaccggaaaccucaucgccccucgcggcuacuucaagauuagaagcgggaaaucuuccaucaugcggagcgacgcucccaucggaaaguguaauucugccugcauuaccccgaacggcagcaucccuaaugauaagcccuuucagaacgucaaucgcauuacauauggcgcguguccuagauacguuaaacaaaacacgcugaaacuugccaccgggaugcggaaugugcccgaaaaacagacacgcggaaucuucggcgcuauugccggguuuaucgagaacggaugggaaggcaugguggacgggugguauggauucagacaccaaaauuccgagggccggggccaggcugccgaccugaagucuacccaggccgcuaucgaucagauuaacgggaaacucaacagacugaucggaaagacaaaugagaaauuccaucagauugaaaaggaguuuagcgaagucgagggccgcauccaagaccuugaaaaguacguggaggauaccaaaauugaccugugguccuauaacgcggagcuccugguugcccuggaaaaucagcacacgaucgaucucacagacagcgagaugaacaagcuguucgaaaagaccaagaaacagcuucgggagaaugcugaagauauggggaacggaugcuuuaagauuuaccauaagugugacaaugccugcaucggcucuaucagaaacgggaccuaugaucacgacguguaccgcgaugaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 190810 - RNA, 1701 nt, Artificial Sequence
  derived and/or modified sequence opt5 from hemagglutinin__InfluenzaA__AET10107
augaagaccaucauugcccugagcuacauccucugccugguguucgcucaggagauucccggcaacgacaauuccacagccacgcuuugucuggggcaccaugcggucccuaacggaaccaucguuaaaacaauuaccaaugaucaaaucgaagugacaaacgcuaccgagcucgugcagucuagcuccacaggcgaaaucugcaauucuccgcaccagauucuggacggggagaacuguacccuuaucgaugcccugcucggagacccccagugcgauggcuuucaaaauaagaaaugggaccuguucgucgaaagaagcaaggcccauuccaacuguuauccuuacgaugugcccgacuaugcuucucugcggagccucguugccuccagcgggacgcuggaguuuaauaacgagucuuucaauuggaccggagugacacagaacggcaccuccagcgcuugcauucgcagaucuaauaacuccuuuuucagccggcuuaauuggcugacacaccucaacuuuaaauacccugcccugaacgucaccaugcccaauaacgaacaguucgauaaacuuuauaucuggggcgugcaucacccugggacggacaaggaucagauuuuucuguacgcgcaagccucuggacgcaucacaguuuccaccaagagaagccagcaggcugugauuccgaauaucggcucccggccccgcgucagaaacaucccuucucgggugagcauuuauuggacaaucgugaagcccggggacauucuccugaucaauuccaccggaaaccugauugccccucgcggcuacuucaaaaucagaagcgggaagucuuccaucaugcggagcgaugcucccauuggaaaauguaauucugccugcaucaccccgaacggcagcauuccuaaugacaagcccuuucagaacgucaaucgcaucacauacggcgcguguccuagauauguuaagcaaaacacgcucaaacuggccaccgggaugcggaaugugcccgagaagcagacacgcggaauuuucggcgcuaucgccggguuuaucgaaaacggaugggagggcaugguggacgggugguacggauucagacaccaaaauuccgagggccggggccaggcugccgaucuuaaaucuacccaggccgcuauugaccagaucaacgggaagcugaacagacucauuggaaaaacaaaugaaaaguuccaucagaucgagaaagaauuuagcgaggucgaaggccgcauucaagaucuggagaaguauguggaggacaccaagaucgaucuuugguccuacaacgcggaacugcucguugcccuggagaaucagcacacgauugaccugacagauagcgaaaugaacaaacucuucgagaagaccaaaaagcagcugcgggaaaaugcugaggacauggggaacggaugcuuuaaaaucuaucauaagugugauaaugccugcaucggcucuauuagaaacgggaccuacgaccacgauguguaucgcgacgaggcccuuaauaaccgguuccagaucaagggcgucgaacugaaauccggauacaaggacuggauucucuggaucagcuuugcuauuucuugcuuccugcuuuguguggcccugcucggcuuuaucaugugggcgugccaaaaagggaauaucaaguguaacauuugcaucuga

SEQ ID NO: 190811 - RNA, 1701 nt, Artificial Sequence; identical to SEQ ID NO: 186435
  derived and/or modified sequence opt5 from hemagglutinin__InfluenzaA__AET10108

SEQ ID NO: 190812 - RNA, 1701 nt, Artificial Sequence; identical to SEQ ID NO: 190006
  derived and/or modified sequence opt5 from hemagglutinin__InfluenzaA__AET10109

SEQ ID NO: 190813 - RNA, 1701 nt, Artificial Sequence
  derived and/or modified sequence opt5 from hemagglutinin__InfluenzaA__AET10110
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucgggugagcaucuacuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauauggcgcguguccuagauacguuaaacaaaacacgcugaaacuugccaccgggaugcggaaugugcccgaaaaacagacacgcggaaucuucggcgcuauugccggguuuaucgagaacggaugggaaggcaugguggacgggugguauggauucagacaccaaaauuccgagggccggggccaggcugccgaucugaagucuacccaggccgcuaucgaccagauuaacgggaaacucaacagacugaucggaaagacaaaugagaaauuccaccagauugaaaaggaguuuagcgaagucgagggccgcauccaagaucuugaaaaguacguggaggacaccaaaauugaucugugguccuauaacgcggagcuccugguugcccuggaaaaucagcauacgaucgaccucacagauagcgagaugaacaagcuguucgaaaagaccaagaaacagcuucgggagaaugcugaagacauggggaacggaugcuuuaagauuuaccacaagugugauaaugccugcaucggcucuaucagaaacgggaccuaugaccaugauguguaccgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucaaauguaacaucugcauuuga

SEQ ID NO: 190814 - RNA, 1701 nt, Artificial Sequence
  derived and/or modified sequence opt5 from hemagglutinin__InfluenzaA__AET10111
augaagaccaucauugcccugagcuacauccucugccugguguucgcucaggagauucccggcaacgacaauuccacagccacgcuuugucuggggcaccaugcggucccuaacggaaccaucguuaaaacaauuaccaaugaucaaaucgaagugacaaacgcuaccgagcucgugcagucuagcuccacaggcgaaaucugcaauucuccgcaccagauucuggacggggagaacuguacccuuaucgaugcccugcucggagacccccagugcgauggcuuucaaaauaagaaaugggaccuguucgucgaaagaagcaaggcccauuccaacuguuauccuuacgaugugcccgacuaugcuucucugcggagccucguugccuccagcgggacgcuggaguuuaauaacgagucuuucaauuggaccggagugacacagaacggcaccuccagcgcuugcauucgcagaucuaauaacuccuuuuucagccggcuuaauuggcugacacaccucaacuuuaaauacccugcccugaacgucaccaugcccaauaacgaacaguucgauaaacuuuauaucuggggcgugcaucacccugggacggacaaggaucagauuuuucuguacgcgcaagccucuggacgcaucacaguuuccaccaagagaagccagcaggcugugauuccgaauaucggcucccggccccgcgucagaaacaucccuucucgggugagcauuuauuggacaaucgugaagcccggggacauucuccuguccaauagcaccggaaaccugaucggcccucgcggguacuucaaaauuagaucuggaaaguccagcaucaugcggucugaugcccccaucggcaaauguaauagcgcuugcauuaccccgaacggcuccaucccuaaugacaagcccuuucagaacgucaaucgcauuacauacggggccuguccuagauauguuaagcaaaacacgcucaaacuggcgaccggaaugcggaaugugcccgagaagcagacacgcggcaucuucggggccauugcuggauuuaucgaaaacggcugggaggggaugguggacggaugguacggcuucagacaccaaaauucugagggccgggggcaggccgcugaucuuaaaagcacccaggccgccaucgaccagauuaacggaaagcugaacagacucaucggcaaaacaaaugaaaaguuccaucagauugagaaagaauuuuccgaggucgaagggcgcauccaagaucuggagaaguauguggaggacaccaagauugaucuuuggagcuacaacgcugaacugcucguugcgcuggagaaucagcacacgaucgaccugacagauucugaaaugaacaaacucuucgagaagaccaaaaagcagcugcgggaaaaugccgaggacaugggaaacggcugcuuuaaaauuuaucauaagugugauaaugcuugcaucggguccaucagaaacggcaccuacgaccacgauguguaucgcgacgaggcccuuaauaaccgguuccagauuaagggagucgaacugaaaagcggcuacaaggacuggauccucuggauuucuuuugccaucuccugcuuccugcuuuguguggcucugcucggguuuauuaugugggccugccaaaaaggaaauaucagauguaacaucugcauuuga

SEQ ID NO: 190815 - RNA, 1701 nt, Artificial Sequence
  derived and/or modified sequence opt5 from hemagglutinin__InfluenzaA__AET10113
augaagaccaucauugcccugagcuacauccucugccugguguucgcucaggagcuucccggcaacgacaauuccacagccacgcugugucucgggcaccaugcgguccaaaacggaaccauuguuaaaacaaucaccaaugaucagauugaagugacaaacgcuaccgagcuggugcagucuagcuccacaggcgaaaucugcaauucuccucaccagauccuugacggggagaacuguacccugauugaugcccuccugggagacccgcaaugcgauggcuuucagaauaagaaaugggaccuguucgucgaaagaagcaaggcccauuccaacuguuaucccuacgaugugccugacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauaccccgcccuuaacgucaccaugccuaauaacgaacaguucgauaagcuguauauuuggggcgugcaucaccccgggacggacaaggaucaaaucuuucucuacgcgcaggccucuggacgcauuacaguuuccaccaaaagaagccagcaggcugugaucccuaauauuggcucccggccgcgcgucagaaacauccccucucgggugagcaucuauuggacaauugugaagccuggggacauccugcugauuaauuccaccggaaaccucaucgcuccccgcggcuacuucaaaauuagaagcgggaagucuuccaucaugcggagcgaugccccuaucggaaaauguaauucugccugcauuacccccaacggcagcaucccgaaugacaagccuuuucaaaacgucaaucgcauuacauacggcgcgugucccagauauguuaagcagaacacgcugaaacuugccaccgggaugcggaaugugccugagaagcagacacgcggaaucuucggcgcuauugccggguuuaucgaaaacggaugggagggcaugguggacgggugguacggauucagacaccaaaauuccgagggccggggccaggcugccgaucugaaaucuacccaggccgcuaucgaccagauuaacgggaagcucaacagacugaucggaaaaacaaaugaaaaguuccaucaaauugagaaagaauuuagcgaggucgaaggccgcauccaggaucuugagaaguauguggaggacaccaagauugaucugugguccuacaacgcggaacuccugguugcccuggagaaucagcacacgaucgaccucacagauagcgaaaugaacaaacuguucgagaagaccaaaaagcagcuucgggaaaaugcugaggacauggggaacggaugcuuuaaaauuuaucauaagugugauaaugccugcaucggcucuaucagaaacgggaccuacgaccacgauguguaucgcgacgaggcccugaauaaccgguuccaaauuaagggcgucgaacucaaauccggauacaaggacuggauccuguggauuagcuuugcuaucucuugcuuccuucuguguguggcccuccugggcuuuauuaugugggcgugccagaaagggaauaucagauguaacaucugcauuuga

SEQ ID NO: 190816 - RNA, 1701 nt, Artificial Sequence
  derived and/or modified sequence opt5 from hemagglutinin__InfluenzaA__AET10114
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguaacucugccugcauuaccccgaauggcagcaucuccaacgacaagccuuuucagaaugucaaccgcauuacauacggcgcgugucccagauauguuaagcaaaauacgcugaaacuugccaccgggaugcggaacgugccugagaagcagacacgcggaaucuucggcgcuauugccggguuuaucgaaaauggaugggagggcaugguggaugggugguacggauucagacaccagaacucugagggccggggccaagcugccgaccugaaaagcacccaggccgcuaucgaucagauuaaugggaagcucaacagacugaucggaaaaacaaacgaaaaguuccaucagauugagaaagaauuuuccgaggucgaaggccgcauccaagaccuugagaaguauguggaggauaccaagauugaccuguggagcuacaaugcggaacuccugguugcccuggagaaccagcacacgaucgaucucacagacucugaaaugaauaaacuguucgagaagaccaaaaagcagcuucgggaaaacgcugaggauauggggaauggaugcuuuaaaauuuaucauaagugugacaacgccugcaucggcuccaucagaaaugggaccuacgaucacgacguguaucgcgacgaggcccugaacaaucgguuccagauuaagggcgucgaacucaaaagcggauacaaggauuggauccuguggauuucuuuugcuaucuccugcuuccuucuguguguggcccuccugggcuuuauuaugugggcgugccaaaaagggaacaucauguguaauaucugcauuuga

SEQ ID NO: 190817 - RNA, 1698 nt, Artificial Sequence
  derived and/or modified sequence opt5 from hemagglutinin__InfluenzaA__AET50439
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcaaucagaaagcccuguaccauaccgagaacgcuuacgugagcgucguuuccucucacuauagcagaaaguucacacccgaaauugccaagcggccuaaagugcgcgaccaggaggggagaaucaauuacuauuggacccuucuggagcccggagauacgauuaucuuugaagcgaacggcaaucucauugccccucgguacgcuuucgcccugucccgcggguuuggaagcggcaucauuaacucuaaugcucccauggacaagugugaugccaaaugccagacaccgcaaggcgcgaucaacuccagccuuccuuuccagaaugugcaucccgucaccaucggggaguguccuaaguaugugagaucugccaaacugcggaugguuacaggacuccgcaacauucccagcauccaguccagaggccuguuuggggcuauugccggauucaucgaaggcggguggaccggaaugguggacggcugguacggcuaucaccaccagaaugagcaagggucuggauacgcugccgaucaaaagagcacccagaacgccauuaauggcaucacaaacaaagucaauuccgugaucgaaaagaugaacacgcaguuuaccgcuguugggaaggaguucaacaaacuggagcggcgcauggaaaaucucaacaagaaaguggacgauggauucauugacaucuggacauacaaugcggagcugcuuguccugcucgaaaacgagagaacccuggauuuucaugacagcaaugugaagaaccuuuaugaaaaagucaagucucagcugaagaauaacgccaaagagauuggcaaugggugcuucgaguuuuaccacaaguguaacgacgaaugcauggaguccgugaaaaauggcacauaugauuaccccaaguauagcgaagagucuaaacucaaccgggagaagaucgacggaguuaagcuggaauccaugggcguguaccagauucuggcuaucuauagcaccgucgccuccucucucgugcugcuuguuagccugggggccaucuccuucuggaugugcucuaauggaagccuccagugucgcauuugcaucuga

SEQ ID NO: 190818 - RNA, 1698 nt, Artificial Sequence
  derived and/or modified sequence opt5 from hemagglutinin__InfluenzaA__AET50440
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuacgcacaccgugacaggaguuuccgccagcugcucucauaacggcgaauccagcuuuuaucgcaaucugcuuuggcugaccggcaaaaacgggcucuaccccaaucugucuaaguccuaugcuaacaauaaagagaaggaagugcugguccucuggggagugcaccacccuccgaacaucggcaaccagaaagcccuguaccauacagagaaugcuuacgugagcgucguuuccucucacuauagcagaaaguucacccccgaaauugccaagcggccuaaagugcgcgaccaggaggggagaaucaacuacuauuggacgcuucuggagcccggagauacaauuaucuuugaagcgaauggcaaccucauugccccucgguacgcuuucgcccugucccgcggguuuggaagcggcaucauuaauucuaacgcucccauggacaagugugaugccaaaugccagaccccgcaaggcgcgaucaauuccagccuuccuuuccagaacgugcaucccgucacaaucggggaguguccuaaguaugugagaucugccaaacugcggaugguuaccggacuccgcaauauucccagcauccaguccagaggccuguuuggggcuauugccggauucaucgaaggcggguggaccggaaugguggacggcugguacggcuaucaccaccagaacgagcaagggucuggauacgcugccgaucaaaagagcacacagaaugccauuaacggcaucacgaauaaagucaacuccgugaucgaaaagaugaauacccaguuuacagcuguugggaaggaguucaacaaacuggagcggcgcauggaaaaccucaauaagaaaguggacgauggauucauugacaucuggaccuacaacgcggagcugcuuguccugcucgaaaaugagagaacacuggauuuucaugacagcaacgugaagaaucuuuaugaaaaagucaagucucagcugaagaacaaugccaaagagauuggcaacgggugcuucgaguuuuaccacaaguguaaugacgaaugcauggaguccgugaaaaacggcaccuaugauuaccccaaguauagcgaagagucuaaacucaaucgggagaagaucgacggaguuaagcuggaauccaugggcguguaccagauucuggcuaucuauagcacggucgccuccucucucgugcugcuuguuagccugggggccaucuccuucuggaugugcucuaacggaagccuccagugucgcauuugcaucuga

SEQ ID NO: 190819 - RNA, 1698 nt, Artificial Sequence
  derived and/or modified sequence opt5 from hemagglutinin__InfluenzaA__AET50441
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuacgcacaccgugacaggaguuuccgccagcugcucucauaacggcgaauccagcuuuuaucgcaaucugcuuuggcugaccggcaaaaacgggcucuaccccaaucugucuaaguccuaugcuaacaauaaagagaaggaagugcugguccucuggggagugcaccacccuccgaacaucggcaaccagaaagcccuguaccauacagagaaugcuuacgugagcgucguuuccucucacuauagcagaaaguucacccccgaaauugccaagcggccuaaagugcgcgggcaggagggaagaaucaacuacuauuggacgcuucuggagcccggcgacacaauuaucuuugaagcgaaugggaaccucauugccccucgguacgcuuucgcccugucccgcggauuuggcagcggcaucauuaauucuaacgcucccauggauaagugugacgccaaaugccagaccccgcaaggggcgaucaauuccagccuuccuuuccagaacgugcaucccgucacaaucggagaguguccuaaguaugugagaucugccaaacugcggaugguuaccggccuccgcaauauucccagcauccaguccagagggcuguuuggagcuauugccggcuucaucgaagggggauggaccggcaugguggauggcugguacggguaucaccaccagaacgagcaaggaucuggcuacgcugccgaccaaaagagcacacagaaugccauuaacgggaucacgaauaaagucaacuccgugaucgaaaagaugaauacccaguuuacagcuguuggaaaggaguucaacaaacuggagcggcgcauggaaaaccucaauaagaaaguggaugacggcuucauugauaucuggaccuacaacgcggagcugcuuguccugcucgaaaaugagagaacacuggacuuucaugauagcaacgugaagaaucuuuaugaaaaagucaagucucagcugaagaacaaugccaaagagauugggaacggcugcuucgaguuuuaccacaaguguaaugacgaaugcauggaguccgugaaaaacggaaccuaugacuaccccaaguauagcgaagagucuaaacucaaucgggagaagaucgauggcguuaagcuggaauccauggggguguaccagauucuggcuaucuauagcacggucgccuccucucucgugcugcuuguuagccugggagccaucuccuucuggaugugcucuaacggcagccuccagugucgcauuugcaucuga

SEQ ID NO: 190820 - RNA, 1698 nt, Artificial Sequence
  derived and/or modified sequence opt5 from hemagglutinin__InfluenzaA__AET50442
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaucuguuauccugggcauuuugccgauuacgaggaacugagagagcaacucuccucugucagcuccuucgaacgguuugagaucuuccccaaggagagcucuuggccuacccacacggugaccggaguuuccgccagcugcucucauaacggcgaauccagcuuuuaucgcaaucugcuuuggcugacaggcaaaaacgggcucuaccccaaucugucuaaguccuaugcuaacaauaaagagaaggaagugcugguccucuggggagugcaccacccuccgaacauuggcaaccagaaagcccuguaccauaccgagaaugcuuacgugagcgucguuuccucucacuauagcagaaaguucacacccgaaaucgccaagcggccuaaagugcgcgggcaggagggaagaauuaacuacuauuggacccuucuggagcccggcgacacgaucauuuuugaagcgaaugggaaccucaucgccccucgguacgcuuucgcccugucccgcggauuuggcagcggcauuaucaauucuaacgcucccauggauaagugugacgccaaaugccagacaccgcaaggggcgaucaauuccagccuuccuuuccagaacgugcaucccgucaccauuggagaguguccuaaguaugugagaucugccaaacugcggaugguuacaggccuccgcaauauccccagcauucaguccagagggcuguuuggagcuaucgccggcuucauugaagggggauggaccggcaugguggauggcugguacggguaucaccaccagaacgagcaaggaucuggcuacgcugccgaccaaaagagcacccagaaugccaucaacgggaucacaaauaaagucaacuccgugauugaaaagaugaauacgcaguuuaccgcuguuggaaaggaguucaacaaacuggagcggcgcauggaaaaccucaauaagaaaguggaugacggcuucaucgauauuuggacauacaacgcggagcugcuuguccugcucgaaaaugagagaacccuggacuuucaugauagcaacgugaagaaucuuuaugaaaaagucaagucucagcugaagaacaaugccaaagagaucgggaacggcugcuucgaguuuuaccacaaguguaaugacgaaugcauggaguccgugaaaaacggaacauaugacuaccccaaguauagcgaagagucuaaacucaaucgggagaagauugauggcguuaagcuggaauccauggggguguaccagauccuggcuaucuauagcaccgucgccuccucucucgugcugcuuguuagccugggagccauuuccuucuggaugugcucuaacggcagccuccagugucgcaucugcauuuga

SEQ ID NO: 190821 - RNA, 1698 nt, Artificial Sequence
  derived and/or modified sequence opt5 from hemagglutinin__InfluenzaA__AET84163
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaaucccugaucucuaaagagagcugguccuacauuguggaaaagccgaaccccgagaauggcaccuguuauccugggcauuuugccgauuacgaggaacuuagagagcaacugucuagcgucuccagcuucgaacgguuugagaucuuccccaaggagucuuccuggccuaaccacacggugaccggaguuagcgccucuugcucccauaauggcgaaagcucuuuuuaucgcaaccuccuguggcuuacaggcaaaaaugggcuguaccccaaccucuccaagagcuaugcuaauaacaaagagaaggaagugcugguccuguggggagugcaccacccuccguccaucucuaaccagaaaacccucuaccauacagagaaugccuacgugagcgucguuuccagccacuauucuagaaaguucacccccgaaguggcuaagcggccuaaagugcgcgaccaggagggcagaauuaacuacuauuggacgcugcuugagcccggggauacaaucauuuuugaagccaauggaaaccugaucgcgccucgguacgccuucgcucucucccgcggcuuugggagcggaauuaucaauucuaacgcccccauggacaagugugaugcuaaaugccagaccccgcaaggcgccauuaauagcucccugccuuuccagaacguccaucccgugacaaucggcgaguguccuaaguauguuagaucugcgaaacuucggauggugaccgggcugcgcaauauccccagcauucaguccagaggacucuuuggcgccaucgcuggguucauugaaggaggcuggaccgggauggucgacggaugguacggcuaucaccaccagaacgagcaaggcagcggguacgccgcugaucagaagucuacacagaaugccaucaacggaauuacgaauaaagugaacuccguuaucgaaaagaugaauacccaguuuacagccgugggcaaggaguucaacaaacuggagcggcgcauggaaaaccugaauaagaaagucgacgauggguucaucgacauuuggaccuacaacgcugagcuccuggugcuucuggaaaaugagagaacacucgauuuucaugacagcaacgucaagaaucuguaugaaaaagugaagucucaacuuaagaacaaugcgaaagagaucggaaacggcugcuucgaguuuuaccacaaguguaaugacgaaugcauggaguccguuaaaaacgggaccuaugauuaccccaaguauagcgaagaguccaaacugaaucgggagaagauugacggcgugaagcucgaaucuaugggagucuaccagauccuggccauuuauagcacgguggcuuccucucugguucuccuggugagccuuggcgccaucuccuucuggaugugcagcaacgggucucugcagugucgcaucugcauuuga

SEQ ID NO: 190822 - RNA, 1698 nt, Artificial Sequence
  derived and/or modified sequence opt5 from hemagglutinin__InfluenzaA__AET84174
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucugaucagaggcuuuggguccggaauuaucaauagcaacgcccccaugggcaagugugaugcuaaaugccagaccccgcaaggcgccaucaauucuucccuuccuuuccagaacguccaccccgugacaauuggggaguguccuaaguauguucggagcgcgaaacugcgcauggugaccggacucagaaauauccccucuauucagagccggggccuguuuggggccaucgcuggauucauugaaggcggguggaccggaauggucgacggcugguacggcuaucaucaccagaacgagcaaggguccggauacgccgcugaucagaagucuacacagaaugccaucaacggcaucacgaauaaagugaacagcguuauugaaaagaugaauacccaguuuacagccguggggaaggaguucaacaaacuggagcgcagaauggaaaaccucaauaagaaagucgacgauggauucaucgacauuuggaccuacaacgcugagcugcuugugcugcucgaaaaugagcggacacuggauuuucacgacuccaacgucaagaaucuuuaugaaaaaguuaagagccaacugaagaacaaugcgaaagagaucggcaacgggugcuucgaguuuuaccauaaguguaaugacgaaugcauggagucugugaaaaacggcaccuaugauuaccccaaguauuccgaagagagcaaacucaaucgcgagaagauugacggagugaagcuggaaucuaugggcgucuaccagauccuggccaucuauuccacgguggcuagcucccucguucugcuugugucucugggggccauuagcuucuggaugugcuccaacggaucucuccaguguagaaucugcauuuga

SEQ ID NO: 190823 - RNA, 1698 nt, Artificial Sequence
  derived and/or modified sequence opt5 from hemagglutinin__InfluenzaA__AET84196
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaaucccugaucucuaaagagagcugguccuacauuguggaaaagccgaaccccgagaauggcaccuguuauccugggcauuuugccgauuacgaggaacuuagagagcaacugucuagcgucuccagcuucgaacgguuugagaucuuccccaaggagucuuccuggccuaaccacacggugaccggaguuagcgccucuugcucccauaauggcgaaagcucuuuuuaucgcaaccuccuguggcuuacacggaaaaauggccuguaccccacccucuccaagagcuaugcuaacaauaaagagaaggaagugcugguccuguggggagugcaccacccuccguccaucaacgaccagaaaacacucuaccauaccgagaacgccuacgugucugucguuagcucccacuauagcagaaaguucacgcccgaaauugcuaagcgcccuaaagugagagaucaggaggggcggaucaauuacuauuggacacugcuugagcccggcgacaccauuaucuuugaagccaacgggaaucugauugcgccucgcuacgccuucgcucucucuagaggauuuggcuccgggaucauuaacagcucugcccccauggauaagugugacgcuaaaugccagacaccgcaaggagccaucaauagcucccugccuuuccagaacgugcaucccgucaccaucggcgaguguccuaaguaugugcggucugcgaaacuucgcaugguuaccggccugagaaauauucccagcauccagucccgggggcucuuuggagccauugcuggcuucaucgaagggggauggacaggcaugguggaugggugguacggauaucaccaccagaacgagcaaggcagcggcuacgccgcugaccagaagucuacgcagaaugccauuaacgggaucaccaauaaagucaacuccgugaucgaaaagaugaauacacaguuuaccgccguuggaaaggaguucaacaaacuggagcgcagaauggaaaaucugaacaagaaaguggaugacggcuucauugauaucuggacauacaacgcugagcuccugguccuucuggaaaaugagcggacccucgacuuucauaacagcaaugugaagaaccuguaugaaaaagucaagucucaacuuaagaauaacgcgaaagagauugggaauggaugcuucgaguuuuaccacaaguguaacgacgaaugcauggaguccgugaaaaauggcacguaugauuaccccaaguauagcgaagaguccaaacugaaccgcgagaagaucgacgggguuaagcucgaaucuaugggcguguaccagauucuggccaucuauagcacagucgcuuccucucuggugcuccugguuagccuuggagccaucuccuucuggaugugcagcaauggcucucugcaguguagaauuugcaucuga

SEQ ID NO: 190824 - RNA, 1698 nt, Artificial Sequence
  derived and/or modified sequence opt5 from hemagglutinin__InfluenzaA__AET84207
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucuguccccagcuucgaacgguuugagaucuucccuaaggaguccagcuggcccaaccacacggugaccggaguuucugccuccugcagccauaauggcgaaucuuccuuuuaucgcaaccugcuuuggcugacaggcaaaaaugggcucuacccuaaccugagcaagucuuaugcuaauaacaaagagaaggaagugcugguccucuggggagugcaccacccgcccuccaucaacgaccagaaaacccuguaccauacagagaaugccuacgugagcgucguuuccucucacuauagcagaaaguucaccccugaaauugcuaagcggcccaaagugcgcgaucaggagggcagaaucaacuacuauuggacgcuucuggagccucgggacacaauuaucuuugaagccaaugggaaccucauugcgccccgcuacgccuucgcucuguccagaggauuuggcagcgggaucauuaauucuaacgccccgauggauaagugugacgcuaaaugccagaccccucaaggagccaucaauuccagccuucccuuccagaacgugcauccugucacaaucggcgagugucccaaguaugugcggucugcgaaacugcgcaugguuaccggccucagaaauauucccagcauccagucccgggggcuguuuggagccauugcuggcuucaucgaagggggauggaccggcaugguggaugggugguacggauaucaccaccagaacgagcaaggcucuggcuacgccgcugaccaaaagagcacacagaaugccauuaacgggaucacgaauaaagucaacuccgugaucgaaaagaugaauacccaguuuacagccguuggaaaggaguucaacaaacuggagcgcagaauggaaaaccucaauaagaaaguggaugacggcuucauugauaucuggaccuacaacgcugagcugcuuguccugcucgaaaaugagcggacacuggacuuucaugacagcaacgugaagaaucuuuaugaaaaagucaagucucagcugaagaacaaugcgaaagagauugggaacggaugcuucgaguuuuaccacaaguguaaugaugaaugcauggaguccgugaaaaacggcaccuaugacuacccuaaguauagcgaagagucuaaacucaaucgcgagaagaucgaugggguuaagcuggaauccaugggcguguaccagauucuggccaucuauagcacggucgcuuccucucucgugcugcuuguuagccugggagccaucuccuucuggaugugcucuaacggcagccuccaguguagaauuugcaucuga

SEQ ID NO: 190825 - RNA, 1698 nt, Artificial Sequence
  derived and/or modified sequence opt5 from hemagglutinin__InfluenzaA__AET84218
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucagcaaucagaaaacccuguaccauacagagaacgccuacguguccgucguuucuagccacuauuccagaaaguucacccccgaaauugcuaagcggccuaaagugcgcgaccaggagggcagaaucaauuacuauuggacgcuucuggagcccggggauacaauuaucuuugaagccagcggaaaccucauugcgccucgguacgccuucgcucugucucgcggcuuuggguccggaaucauuaauagcaacgcccccauggacaagugugaugcuaaaugccagaccccgcaaggcgccaucaauucuagccuuccuuuccagaacgugcaucccgucacaaucggcgaguguccuaaguaugugagauccgcgaaacugcggaugguuaccgggcuccgcaauauucccucuauccagagcagaggacuguuuggcgccauugcuggguucaucgaaggaggcuggaccgggaugguggacggaugguacggcuaucaccaccagaacgagcaaggcuccggguacgccgcugaucaaaagagcacacagaaugccauuaacggaaucacgaauaaagucaacucugugaucgaaaagaugaauacccaguuuacagccguuggcaaggaguucaacaaacuggagcggcgcauggaaaaccucaauaagaaaguggacgauggguucauugacaucuggaccuacaacgcugagcugcuuguccugcucgaaaaugagagaacacuggauuuucaugacuccaacgugaagaaucuuuaugaaaaagucaagagccagcugaagaacaaugcgaaagagauuggaaacggcugcuucgaguuuuaccacaaguguaaugacgaaugcauggagucugugaaaaacgggaccuaugauuaccccaaguauuccgaagagagcaaacucaaucgggagaagaucgacggcguuaagcuggaauccaugggaguguaccagauucuggccaucuauucuacggucgcuagcucccucgugcugcuuguuucucugggcgccaucagcuucuggaugugcuccaacgggagccuccagugucgcauuugcaucuga

SEQ ID NO: 190826 - RNA, 1698 nt, Artificial Sequence
  derived and/or modified sequence opt5 from hemagglutinin__InfluenzaA__AET84229
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccacccugucuaaguccuaugcuaacaauaaagagaaggaagugcugguccucuggggagugcaccacccuccgaacaucguggaccagaaaacacuguacagaaccgagaacgccuacgucagcguuguguccucucauuauagccggaaguucacgcccgaaauugcuaagcgcccuaaagugagagaucaggagggccggaucaauuacuauuggacacuucuggagcccggggacaccauuaucuuugaagccaacggaaaucucauugcgccucgcuacgccuucgcucuguccagaggcuuugggagcggaaucauuaacucuaaugcccccaugggcaagugugaugcuaaaugccagacaccgcaaggcgccaucaacuccagccuuccuuuccagaauguccaccccgugaccaucggggaguguccuaaguauguucggucugcgaaacugcgcauggugaccggacucagaaacauuccucccauccagagccggggccuguuuggggccauugcuggauucaucgaaggcggguggacaggaauggucgacggcugguacggcuaucaucaccagaaugagcaaggguccggauacgccgcugaucagaagucuacgcagaacgccauuaauggcaucaccaacaaagugaauagcguuaucgaaaagaugaacacacaguuuaccgccguggggaaggaguucaauaaacuggagcgcagaauggaaaaccucaacaagaaagucgacgauggauucauugacaucuggacauacaaugcugagcugcuugugcugcucgaaaacgagcggacccuggauuuucacgacuccaaugucaagaaccuuuaugaaaaaguuaagagccaacugaagaauaacgcgaaagagauuggcaaugggugcuucgaguuuuaccauaaguguaacgacgaaugcauggagucugugaaaaauggcacguaugauuaccccaaguauuccgaagagagcaaacucaaccgcgagaagaucgacggagugaagcuggaaucuaugggcgucuaccagauucuggccaucuauuccacaguggcuagcucccucguucugcuugugucucugggggccaucagcuucuggaugugcuccaauggaucucuccaguguagaauuugcaucuga

SEQ ID NO: 190827 - RNA, 1698 nt, Artificial Sequence
  derived and/or modified sequence opt5 from hemagglutinin__InfluenzaA__AET84240
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccuggguacuuugccgauuaugaggaacugagagagcaacucuccucugucagcuccuucgaacgguuugagaucuuccccaaggagagcucuuggccuaaccauacggugaccggaguuuccgccagcugcucucacaauggcgaauccagcuuuuaccgcaaccugcuuuggcugacaggcaaaaaugggcucuaucccaaccugucuaaguccuacgcuaauaacaaagagaaggaagugcugguccucuggggagugcaucacccuccgaacaucguggaccagaaaacccuguacagaacagagaaugccuaugucagcguuguguccucucacuacagccggaaguucacccccgaaauugcuaagcgcccuaaagugagagaucaggagggccggaucaacuauuacuggacgcuucuggagcccggggacacaauuaucuuugaagccaauggaaaccucauugcgccucgcuaugccuucgcucuguccagaggcuuugggagcggaaucauuaauucuaacgcccccaugggcaagugugaugcuaaaugccagaccccgcaaggcgccaucaauuccagccuuccuuuccagaacguccaucccgugacaaucggggaguguccuaaguacguucggucugcgaaacugcgcauggugaccggacucagaaauauucccagcauccagucccggggccuguuuggggccauugcuggauucaucgaaggcggguggaccggaauggucgacggcugguauggcuaccaccaucagaacgagcaagggucuggauacgccgcugaucaaaagagcacacagaaugccauuaacggcaucacgaauaaagugaacuccguuaucgaaaagaugaauacccaguuuacagccguggggaaggaguucaacaaacuggagcgcagaauggaaaaccucaauaagaaagucgacgauggauucauugacaucuggaccuauaacgcugagcugcuugugcugcucgaaaaugagcggacacuggauuuucacgacagcaacgucaagaaucuuuacgaaaaagugaagucucagcugaagaacaaugcgaaagagauuggcaacgggugcuucgaguuuuaucacaaguguaauaacgaaugcauggaguccguuaaaaauggcaccuacgacuaucccaaguacagcgaagagucuaaacucaaccgcgagaagaucgauggagugaagcuggaauccaugggcgucuaucagauucuggccaucuacagcacgguggcuuccucucucguucugcuugugagccugggggccaucuccuucuggaugugcucuaauggaagccuccaguguagaauuugcaucuga

SEQ ID NO: 190828 - RNA, 1698 nt, Artificial Sequence
  derived and/or modified sequence opt5 from hemagglutinin__InfluenzaA__AET84251
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucgugaaucagaaaacccuguacagaacagagaacgccuacgucagcguuguguccucucauuauagccggaaguucacccccgaaauugcuaagcgcccuaaagugagagaccaggagggccggaucaauuacuauuggacgcuucuggagcccggggauacaauuaucuuugaagccaacggaaaucucauugcgccucgcuacgccuucgcucuguccagaggcuuugggagcggaaucauuaacucuaaugcccccaugggcaagugugacgcuaaaugccagaccccgcacggcgccaucaacuccugucuuccuuuccaaaauguccaucccgugacaaucggggagugcccuaaguauguucggagcgcgaaacugcgcauggugaccggacucagaaacauucccucuauccagagccggggccuguuuggggccauugcuggauucaucgaaggcggguggaccggaauggucgauggcugguacggcuaucaccaccagaaugagcagggguccggauacgccgcugaccaaaagucuacacagaacgccauuaauggcaucacgaacaaagugaauagcguuaucgaaaagaugaacacccaguuuacagccguggggaaggaguucaacaaacuggagcgcagaauggaaaaucucaacaagaaagucgaugacggauucauugauaucuggaccuacaaugcugagcugcuugugcugcucgaaaacgagcggacacuggacuuucaugauuccaaugucaagaaccuuuaugaaaaaguuaagagccagcugaagaauaacgcgaaagagauuggcaauggguguuucgaguuuuaccacaagugcaacgacgaaugcauggagucugugaaaaauggcaccuaugacuaccccaaguauuccgaagagagcaaacucaacaaggagaagaucgauggagugaaacuggaaucuaugggcgucuaccaaauucuggccaucuauuccacgguggcuagcucccucguucugcuugugucucugggggccaucagcuucuggauguguuccaauggaucucuccagugccgcauuuguaucuga

SEQ ID NO: 190829 - RNA, 1698 nt, Artificial Sequence
  derived and/or modified sequence opt5 from hemagglutinin__InfluenzaA__AET84262
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcacggcgccaucaauuccugucuuccuuuccaaaacguccaucccgugacaaucggcgagugcccuaaguauguucggagcgcgaaacugcgcauggugaccgggcucagaaauauucccucuauccagagccggggacuguuuggcgccauugcuggguucaucgaaggaggcuggaccgggauggucgauggaugguacggcuaucaccaccagaacgagcagggcuccggguacgccgcugaccaaaagucuacacagaaugccauuaacggaaucacgaauaaagugaacagcguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucaugacuccaacgucaagaaucuuuaugaaaaaguuaagagccagcugaagaacaaugcgaaagagauuggaaacggcuguuucgaguuuuaccacaagugcaaugaugaaugcauggagucugugaaaaacgggaccuaugacuaccccaaguauuccgaagagagcaaacucaaucgcgagaagaucgauggcgugaagcuggaaucuaugggagucuaccaaauucuggccaucuauuccacgguggcuagcucccucguucugcuugugucucugggcgccaucagcuucuggauguguuccaacgggucucuccagugcagaauuuguaucuga

SEQ ID NO: 190830 - RNA, 1698 nt, Artificial Sequence; identical to SEQ ID NO: 190757
  derived and/or modified sequence opt5 from hemagglutinin__InfluenzaA__AET84284

SEQ ID NO: 190831 - RNA, 1698 nt, Artificial Sequence
  derived and/or modified sequence opt5 from hemagglutinin__InfluenzaA__AET84306
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcaaucagaaagcccuguaccauaccgagaacgcuuacgugagcgucguuuccucucacuauagcauuaaguucacacccgaaaucgccaagagaccuaaagugcgggaccaggaggggcgcauuaauuacuauuggacccuucuggagcccggagauacgaucauuuuugaagcgaacggcaaucucaucgccccuagauacgcuuucgcccugucccggggguuuggaagcggcauuaucaacucuaaugcucccauggacaagugugaugccaaaugccagacaccgcaaggcgcgaucaacuccagccuuccuuuccagaaugugcaucccgucaccauuggggaguguccuaaguaugugcgcucugccaaacugagaaugguuacaggacuccggaacauccccagcauucagucccgcggccuguuuggggcuaucgccggauucauugaaggcggguggaccggaaugguggacggcugguacggcuaucaccaccagaaugagcaagggucuggauacgcugccgaucaaaagagcacccagaacgccaucaauggcaucacaaacaaagucaauuccgugauugaaaagaugaacacgcaguuuaccgcuguugggaaggaguucaacaaacuggagagacggauggaaaaucucaacaagaaaguggacgauggauucaucgacauuuggacauacaaugcggagcugcuuguccugcucgaaaacgagcgcacccuggauuuucaugacagcaaugugaagaaccuuuaugaaaaagucaagucucagcugaagaauaacgccaaagagaucggcaaugggugcuucgaguuuuaccacaaguguaacgacgaaugcauggaguccgugaaaaauggcacauaugauuaccccaaguauagcgaagagucuaaacucaacagagagaagauugacggaguuaagcuggaauccaugggcguguaccagauccuggcuaucuauagcaccgucgccuccucucucgugcugcuuguuagccugggggccauuuccuucuggaugugcucuaauggaagccuccagugucggaucugcauuuga

SEQ ID NO: 190832 - RNA, 1698 nt, Artificial Sequence
  derived and/or modified sequence opt5 from hemagglutinin__InfluenzaA__AET84339
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccgaacaucggcaaucagaaaacccuguaccauacagagaacgccuacguguccgucguuagcucccacuauucucggaaguucacccccgaaauugcuaagcgcccuaaagugagagaccaggaggggcggaucaauuacuauuggacgcuucuggagcccggagauacaauuaucuuugaagccaacggcaaucucauugcgccucgcuacgccuucgcucugagcagaggguuuggauccggcaucauuaacagcaaugcccccauggacaagugugaugcuaaaugccagaccccgcaaggcgccaucaacucuucccuuccuuuccagaaugugcaucccgucacaaucggggaguguccuaaguaugugcggagcgcgaaacugcgcaugguuaccggacucagaaacauucccucuauccagagccggggccuguuuggggccauugcuggauucaucgaaggcggguggaccggaaugguggacggcugguacggcuaucaccaccagaaugagcaaggguccggauacgccgcugaucagaagucuacacagaacgccauuaauggcaucacgaacaaagucaauagcgugaucgaaaagaugaacacccaguuuacagccguugggaaggaguucaacaaacuggagcgcagaauggaaaaucucaacaagaaaguggacgauggauucauugacaucuggaccuacaaugcugagcugcuuguccugcucgaaaacgagcggacacuggauuuucaugacuccaaugugaagaaccuuuaugaaaaagucaagagccaacugaagaauaacgcgaaagagauuggcaaugggugcuucgaguuuuaccacaaguguaacgacgaaugcauggagucugugaaaaauggcaccuaugauuaccccaaguauuccgaagagagcaaacucaaccgcgagaagaucgacggaguuaagcuggaaucuaugggcguguaccagauucuggccaucuauuccacggucgcuagcucccucgugcugcuuguuucucugggggccaucagcuucuggaugugcuccaauggaucucuccaguguagaauuugcaucuga

SEQ ID NO: 190833 - RNA, 1698 nt, Artificial Sequence; identical to SEQ ID NO: 190832
  derived and/or modified sequence opt5 from hemagglutinin__InfluenzaA__AET84361

SEQ ID NO: 190834 - RNA, 1698 nt, Artificial Sequence
  derived and/or modified sequence opt5 from hemagglutinin__InfluenzaA__AET84372
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccgaacaucggcgaccagaaaacccuguaccauacagagaaugccuacguguccgucguuagcucccacuauucucggaaguucacccccgaaauugcuaagcgcccuaaagugagagaucaggaggggcggaucaacuacuauuggacgcuucuggagcccggagacacaauuaucuuugaagccaauggcaaccucauugcgccucgcuacgccuucgcucugagcagaggguuuggauccggcaucauuaauagcaacgcccccauggauaagugugacgcuaaaugccagaccccgcaaggcgccaucaauucuucccuuccuuuccagaacgugcaucccgucacaaucggggaguguccuaaguaugugcggagcgcgaaacugcgcaugguuaccggacucagaaauauucccucuauccagagccggggccuguuuggggccauugcuggauucaucgaaggcggguggaccggaaugguggauggcugguacggcuaucaccaccagaacgagcaaggguccggauacgccgcugaccagaagucuacacagaaugccauuaacggcaucacgaauaaagucaacagcgugaucgaaaagaugaauacccaguuuacagccguugggaaggaguucaacaaacuggagcgcagaauggaaaaccucaauaagaaaguggaugacggauucauugauaucuggaccuacaacgcugagcugcuuguccugcucgaaaaugagcggacacuggacuuucaugacuccaacgugaagaaucuuuaugaaaaagucaagagccaacugaagaacaaugcgaaagagauuggcaacgggugcuucgaguuuuaccacaaguguaaugaugaaugcauggagucugugaaaaacggcaccuaugacuaccccaaguauuccgaagagagcaaacucaaucgcgagaagaucgauggaguuaagcuggaaucuaugggcguguaccagauucuggccaucuauuccacggucgcuagcucccucgugcugcuuguuucucugggggccaucagcuucuggaugugcuccaacggaucucuccaguguagaauuugcaucuga

SEQ ID NO: 190835 - RNA, 1698 nt, Artificial Sequence
  derived and/or modified sequence opt5 from hemagglutinin__InfluenzaA__AET84394
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccggacaucggcaaccagaaaacccuguaccauacagagaaugccuacguguccgucguuagcucccacuauucucggaaguucacccccgaaauugcuaagcgcccuaaagugagagaucaggaggggcggaucaacuacuauuggacgcuucuggagcccggagacacaauuaucuuugaagccaauggcaaccucauugcgccucgcuacgccuucgcucugagcagaggguuuggauccggcaucauuaauagcaacgcccccauggauaagugugacgcuaaaugccagaccccgcaaggcgccaucaauucuucccuuccuuuccagaacgugcaucccgucacaaucggggaguguccuaaguaugugcggagcgaaaaacugcgcaugguuaccggacucagaaauauucccucuauccagagccggggccuguuuggggcgauugccggauucaucgagggcggguggaccggaaugguggauggcugguacggcuaucaccaccagaacgaacaaggguccggauacgcugccgaccagaagucuacacagaaugcuauuaacggcaucacgaauaaagucaacagcgugaucgagaagaugaauacccaguuuacagccguugggaaggaguucaacaaacuggaacgcagaauggagaaccucaauaagaaaguggaugacggauucauugauaucuggaccuacaacgccgaacugcuuguccugcucgagaaugaacggacacuggacuuucaugacuccaacgugaagaaucuuuaugagaaagucaagagccaacugaagaacaaugcuaaagagauuggcaacgggugcuucgaauuuuaccacaaguguaaugaugagugcauggaaucugugaaaaacggcaccuaugacuaccccaaguauuccgaggagagcaaacucaaucgcgaaaagaucgauggaguuaagcuggagucuaugggcguguaccagauucuggcgaucuauuccacggucgccagcucccucgugcugcuuguuucucugggggcuaucagcuucuggaugugcuccaacggaucucuccaguguagaauuugcaucuga

SEQ ID NO: 190836 - RNA, 1698 nt, Artificial Sequence; identical to SEQ ID NO: 188540
  derived and/or modified sequence opt5 from hemagglutinin__InfluenzaA__AET84405

SEQ ID NO: 190837 - RNA, 1698 nt, Artificial Sequence
  derived and/or modified sequence opt5 from hemagglutinin__InfluenzaA__AET84416
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccacccugagcaagucuuaugcuaacaauaaagagaaggaagugcugguccucuggggagugcaccacccuccggacaucggcgaucagaaaacacuguaccauaccgagaacgccuacguguccgucguuagcucccacuauucucggaaguucacgcccgaaauugcuaagcgcccuaaagugagagaccaggaggggcggaucaacuacuauuggacacuucuggagcccggagauaccauuaucuuugaagccaauggcaaccucauugcgccucgcuacgccuucgcucugagcagaggguuuggauccggcaucauuaauagcaacgcccccauggacaagugugaugcuaaaugccagacaccgcaaggcgccaucaauucuucccuuccuuuccagaacgugcaucccgucaccaucggggaguguccuaaguaugugcggagcgcgaaacugcgcaugguuaccggacucagaaauauucccucuauccagagccggggccuguuuggggccauugcuggauucaucgaaggcggguggacaggaaugguggacggcugguacggcuaucaccaccagaacgagcaaggguccggauacgccgcugaucagaagucuacgcagaaugccauuaacggcaucaccaauaaagucaacagcgugaucgaaaagaugaauacacaguuuaccgccguugggaaggaguucaacaaacuggagcgcagaauggaaaaucucaacaagaaaguggacgauggauucauugacaucuggacauacaacgcugagcugcuuguccugcucgaaaaugagcggacccuggacuuucaugauuccaacgugaagaaucuuuaugaaaaagucaagagccaacugaagaacaaugcgaaagagauuggcaacgggugcuucgaguuuuaccacaaguguaaugacgaaugcauggagucugugaaaaacggcacguaugauuaccccaaguauuccgaagagagcaaacucaaucgcgagaagaucgacggaguuaagcuggaaucuaugggcguguaccagauucuggccaucuauuccacagucgcuagcucccucgugcugcuuguuucucugggggccaucagcuucuggaugugcuccaacggaucucuccaguguagaauuugcaucuga

SEQ ID NO: 190838 - RNA, 1698 nt, Artificial Sequence
  derived and/or modified sequence opt5 from hemagglutinin__InfluenzaA__AET84427
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcaaucagaaaacccuguaccauacagagaacgccuacgugagcgucguuuccucucacuauagcagaaaguucacccccgaaauugcuaagcggccuaaagugcgcgaccaggaggggagaaucaauuacuauuggacgcuucuggagcccggagauacaauuaucuuugaagccaacggcaaucucauugcgccucgguacgccuucgcucugucccgcggguuuggaagcggcaucauuaacucuaaugcccccauggacaagugugaugcuaaaugccagaccccgcaaggcgccaucaacuccagccuuccuuuccagaaugugcaucccgucacaaucggggaguguccuaaguaugugagaucugcgaaacugcggaugguuaccggacuccgcaacauucccagcauccaguccagaggccuguuuggggccauugcuggauucaucgaaggcggguggaccggaaugguggacggcugguacggcuaucaccaccagaaugagcaagggucuggauacgccgcugaucaaaagagcacacagaacgccauuaauggcaucacgaacaaagucaauuccgugaucgaaaagaugaacacccaguuuacagccguugggaaggaguucaacaaacuggagcggcgcauggaaaaucucaacaagaaaguggacgauggauucauugacaucuggaccuacaaugcugagcugcuuguccugcucgaaaacgagagaacacuggauuuucaugacagcaaugugaagaaccuuuaugaaaaagucaagucucagcugaagaauaacgcgaaagagauuggcaaugggugcuucgaguuuuaccacaaguguaacgacgaaugcauggaguccgugaaaaauggcaccuaugauuaccccaaguauagcgaagagucuaaacucaaccgggagaagaucgacggaguuaagcuggaauccaugggcguguaccagauucuggccaucuauagcacggucgcuuccucucucgugcugcuuguuagccugggggccaucuccuucuggaugugcucuaauggaagccuccagugucgcauuugcaucuga

SEQ ID NO: 190839 - RNA, 1698 nt, Artificial Sequence
  derived and/or modified sequence opt5 from hemagglutinin__InfluenzaA__AET84438
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgugcagaaaacccuguacaauacagagaacgccuacgucagcguuguguccucucauuauagcagaaaguucacccccgaaauugcuaagcggccuaaagugcgcgaccaggaggggagaaucaauuacuauuggacgcuucuggagcccggagauacaauuauguuugaagccaacggcaaucucaucgcgccucgguacgccuucgcucugucccgcggguuuggaagcggcauuaucaacucuaaugcccccauggacaagugugaugcuaaaugccagaccccgcaaggcgccauuaacuccagccuuccuuuccagaauguccaccccgugacaaucggggaguguccuaaguauguuagaucugcgaaacugcggauggugaccggacuccgcaacauccccagcauucaguccagaggccuguuuggggccaucgcuggauucauugaaggcggguggaccggaauggucgacggcugguacggcuaucaucaccagaaugagcaagggucuggauacgccgcugaucagaaguccacacagaacgccaucaauggcauuacgaacaaagugaauagcguuaucgaaaagaugaacacccaguuuacagccguggggaaggaguucaacaaacuggagcggcgcauggaaaaucucaacaagaaagucgacgauggauucaucgacauuuggaccuacaaugcugagcugcuugugcugcucgaaaacgagagaacacuggauuuucacgacagcaaugucaagaaccuuuaugaaaaagugaagucucaacugaagaauaacgcgaaagagaucggcaaugggugcuucgaguuuuaccauaaguguaacgacgaaugcauggaguccguuaaaaauggcaccuaugauuaccccaaguauagcgaagagucuaaacucaaccgggagaagauugacggagugaagcuggaauccaugggcgucuaccagauccuggccauuuauagcacgguggcuuccucucucguucugcuugugagccugggggccaucuccuucuggaugugcucuaauggaagccuccagugucgcaucugcauuuga

SEQ ID NO: 190840 - RNA, 1698 nt, Artificial Sequence
  derived and/or modified sequence opt5 from hemagglutinin__InfluenzaA__AET84449
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgaucagagagcccuguaccauacagagaacgcuuacgugagcguggucuccucucacuauagccggaaauucacccccgaaauugccaagcgcccuaagguuagagaccaggaggggcggaucaauuacuauuggacgcuucuggagcccggagauacaauuaucuuugaagcgaacggcaaucucauugccccucgcuacgcuuucgcccuguccagaggguuuggaagcggcaucauuaacucuaaugcucccauggacggcugugaugccaaaugccagaccccgcaaggggcgaucaacuccagccuuccuuuccagaaugugcaucccgugacaaucggagaguguccuaaguauguccggucugccaaacugcgcauggugaccggccucagaaacauucccagcauccagucccgggggcuguuuggagcuauugccggcuucaucgaagggggauggaccggcaugguugacggcugguacggguaucaccaccagaaugagcaaggaucuggcuacgcugccgaucagaaguccacacagaacgccauuaaugggaucacgaacaaagugaauagcgucaucgaaaagaugaacacccaguuuacagcugugggaaaagaguucaauaagcuggagcgcagaauggaaaaccucaacaagaaaguugacgauggcuucauugacaucuggaccuacaaugcggagcugcuugugcugcucgaaaacgagcggacacuggacuuucaugauagcaaugucaagaaccuuuaugaaaaagugaagucucaacugaaaaauaacgccaaggagauugggaauggcugcuucgaguuuuaccacaaguguaacgacgaaugcauggaguccgucaaaaauggaaccuaugauuaccccaaguauagcgaagagucuaaacucaaccgcgagaagaucgacggcgugaaacuggaauccauggggguuuaccagauucuggcuaucuauagcacgguggccuccucucucguccugcuugugagccugggagccaucuccuucuggaugugcucuaauggcagccuccaguguagaauuugcaucuga

SEQ ID NO: 190841 - RNA, 1701 nt, Artificial Sequence
  derived and/or modified sequence opt5 from hemagglutinin__InfluenzaA__AET98600
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccgugcccaacaaugagcaguucgacaagcuguacauuuggggcguucaccauccugggacggauaaagaccagaucuuucucuaugcgcaagccucuggacgcauuacaguguccaccaagagaagccagcaggcugucaucccgaacauuggcucccggccccgcgugagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugucaaccgcaucacauauggcgccuguccuagauacguuaaacaauccacgcugaagcuggcgaccgggaugcggaaugugcccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgaggucgaaggccgcauucaagaccuugagaaguacguggaggauaccaaaaucgaccuguggagcuauaacgcugaacuccugguugcgcuggagaaucagcauacgauugaucucacagacucugaaaugaacaagcuguucgagaaaaccaagaaacagcuucgggaaaaugccgaggauauggggaacggaugcuuuaccaucuaccacaagugugacaaugcuugcaucggcuccauuagaaacgggacauaugaucauaauguguaccgcgacgaggcccugaacaaucgguuccagaucaagggcgucgaacucaaaagcggauacaaggacuggauucuguggaucucuuuugccauuuccugcuuccuucuguguguggcucuccugggcuuuaucaugugggccugccaaaaagggaacaucagauguaauauuugcaucuga

SEQ ID NO: 190842 - RNA, 1701 nt, Artificial Sequence
  derived and/or modified sequence opt5 from hemagglutinin__InfluenzaA__AEV76874
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacagccuccucuuggagcuacaucguggagaccuccucuagcgacaacggcacgugcuauccgggggauuucauugacuacgaagaacuccgggagcagcuguccagcgucucuuccuuugaacgcuucgagaucuuucccaagaccagcucuuggccuaaucacgauuccaacaagggagugacagccgcuuguccccaugccggcgcgaaaggcuucuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguuuguggggacgucuagauauagcaagaaauucaauccugagauugagauccggccgaagguccgcgaucaggaaggaagaaugaacuacuauuggacacucguugagcccggcgacaaaauuaccuuugaagccacagggaaccugguggugccucgguacgcuuucgccauggagcgcaaugcgggauccggcaucauuaucagcgauacccccguccaugacugcaacaccacaugucaaacgccuaagggcgccaucaauaccucucugcccuuucagaacauucacccgaucacaauugggaaaugcccuaaguaugugaaguccaccaaacucagacuggcuacaggacuucggaauguucccagcauccagucucgcggccuguucggggccauugcuggauuuaucgaaggcggguggaccggaaugguggacggcugguacggcuaucaucaccagaacgagcaagggagcggauacgccgccgaucucaaguccacgcagaaugcuaucgacaaaauuacaaacaaggucaauucugugaucgagaaaaugaacacccaguucaccgcgguuggcaaggaguucaaucaccuggagaagagaauugaaaaccuuaauaaaaagguggaugacggguuucuggauaucuggacauacaacgccgagcuccugguccugcucgaaaaugagcggacccuggacuaucaugauagcaacgugaaaaaccuuuacgagaagguccgcaaucagcugaaaaacaaugcuaaggaaauuggaaacggcuguuucgaguuuuaucacaagugcgacaauacauguauggaauccgugaaaaacgggacguacgauuauccuaaguacagcgaggaagccaaacucaauagagaggagaucgacggcguuaagcuggaaucuacccggaucuaucaaauucuugccaucuacuccacaguggcuagcucucugguccucgugguuucccugggagccauuagcuucuggaugugcuccaacggcucucugcagugccgcaucuguauuuga

SEQ ID NO: 190843 - RNA, 1701 nt, Artificial Sequence; identical to SEQ ID NO: 185693
  derived and/or modified sequence opt5 from hemagglutinin__InfluenzaA__AEW10574

SEQ ID NO: 190844 - RNA, 1701 nt, Artificial Sequence; identical to SEQ ID NO: 185693
  derived and/or modified sequence opt5 from hemagglutinin__InfluenzaA__AEW10584

SEQ ID NO: 190845 - RNA, 1701 nt, Artificial Sequence; identical to SEQ ID NO: 186046
  derived and/or modified sequence opt5 from hemagglutinin__InfluenzaA__AEW10594

SEQ ID NO: 190846 - RNA, 1701 nt, Artificial Sequence; identical to SEQ ID NO: 186046
  derived and/or modified sequence opt5 from hemagglutinin__InfluenzaA__AEW10604

SEQ ID NO: 190847 - RNA, 1701 nt, Artificial Sequence; identical to SEQ ID NO: 186046
  derived and/or modified sequence opt5 from hemagglutinin__InfluenzaA__AEW10614

SEQ ID NO: 190848 - RNA, 1701 nt, Artificial Sequence; identical to SEQ ID NO: 186046
  derived and/or modified sequence opt5 from hemagglutinin__InfluenzaA__AEW10624

SEQ ID NO: 190849 - RNA, 1701 nt, Artificial Sequence; identical to SEQ ID NO: 185693
  derived and/or modified sequence opt5 from hemagglutinin__InfluenzaA__AEW10634

SEQ ID NO: 190850 - RNA, 1701 nt, Artificial Sequence; identical to SEQ ID NO: 185680
  derived and/or modified sequence opt5 from hemagglutinin__InfluenzaA__AEW10644

SEQ ID NO: 190851 - RNA, 1701 nt, Artificial Sequence
  derived and/or modified sequence opt5 from hemagglutinin__InfluenzaA__AEW10654
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccgccgaucaacagucucucuaccagaaugcugacgccuacguguucgugggcagcuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 190852 - RNA, 1701 nt, Artificial Sequence; identical to SEQ ID NO: 185680
  derived and/or modified sequence opt5 from hemagglutinin__InfluenzaA__AEW10664

SEQ ID NO: 190853 - RNA, 1701 nt, Artificial Sequence
  derived and/or modified sequence opt5 from hemagglutinin__InfluenzaA__AEW10674
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccgaagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaguccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 190854 - RNA, 1701 nt, Artificial Sequence; identical to SEQ ID NO: 185693
  derived and/or modified sequence opt5 from hemagglutinin__InfluenzaA__AEW10684

SEQ ID NO: 190855 - RNA, 1701 nt, Artificial Sequence; identical to SEQ ID NO: 185680
  derived and/or modified sequence opt5 from hemagglutinin__InfluenzaA__AEW10694

SEQ ID NO: 190856 - RNA, 1701 nt, Artificial Sequence; identical to SEQ ID NO: 185680
  derived and/or modified sequence opt5 from hemagglutinin__InfluenzaA__AEW10704

SEQ ID NO: 190857 - RNA, 1701 nt, Artificial Sequence; identical to SEQ ID NO: 190851
  derived and/or modified sequence opt5 from hemagglutinin__InfluenzaA__AEW10724

SEQ ID NO: 190858 - RNA, 1701 nt, Artificial Sequence; identical to SEQ ID NO: 185693
  derived and/or modified sequence opt5 from hemagglutinin__InfluenzaA__AEW10734

SEQ ID NO: 190859 - RNA, 1701 nt, Artificial Sequence
  derived and/or modified sequence opt5 from hemagglutinin__InfluenzaA__AEW10744
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucugucucgcggacucuuuggcgccaucgccggguucaucgagggaggcuggacagggaugguggacggaugguacggcuaucaucaccagaaugaacagggcagcggguacgcugcggaucugaaauccacccaaaacgccauugacgagaucacaaauaaggucaacagcgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauucuaaugugaaaaaccuguacgagaagguccgcucccagcucaaaaacaaugccaaggaaaucgggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggauuuaucagauccuggccauuuacagcacaguggcguccucucucguccuggugguuagccugggcgcuaucuccuuuuggaugugcucuaacggaagccuccaaugccgcauuuguaucuga

SEQ ID NO: 190860 - RNA, 1701 nt, Artificial Sequence; identical to SEQ ID NO: 190859
  derived and/or modified sequence opt5 from hemagglutinin__InfluenzaA__AEW10754

SEQ ID NO: 190861 - RNA, 1701 nt, Artificial Sequence
  derived and/or modified sequence opt5 from hemagglutinin__InfluenzaA__AEW10764
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcuaaugccuacguguucgugggauccagcagauauucuaagaaauuuaagccugagaucgcuauucggccgaaaguccgcgaccaggaggggagaaugaacuacuauuggacacucguugaacccggagauaagaucaccuucgaggccacgggcaaccugguggugccucgguacgcguuugccauggaacgcaaugcuggguccggaauuaucaucagcgacacacccguccaugauugcaacaccacaugucaaaccccuaaaggcgccauuaauaccucucugcccuuccagaacauccacccgauuacaaucggcaagugcccuaaguaugugaaaagcacgaagcucagacuggcuaccgggcuucggaauguucccuccauucagucucgcggacuguuuggcgccaucgccggguucaucgagggaggcuggacagggaugguggacggaugguacggcuaucaucaccagaacgaacaaggcagcggguacgcugcggaccucaaauccacccagaaugccauugaugagaucacaaacaaggucaauagcgugauugagaaaaugaacacccaguuuacggcuguuggaaaggaguucaaucaccuggagaagagaaucgaaaaccuuaauaaaaagguggacgauggcuuccuggacauuuggacauacaacgccgagcuccugguccugcucgaaaaugagcggacccuggauuaucaugacucuaacgugaaaaaccuuuacgagaagguccgcucccagcugaaaaauaacgccaaggaaaucgggaauggauguuuugaguucuaucacaagugcgauaacaccuguauggaaagcgugaaaaauggcacauacgacuauccuaaguacucugaggaagcuaaacucaacagagaggagaucgaugggguuaagcuggaauccacccggauuuaucaaauccuugccauuuacagcacaguggcguccucucugguccucgugguuagccugggcgcuaucuccuuuuggaugugcucuaauggaagccugcagugccgcauuuguaucuga

SEQ ID NO: 190862 - RNA, 1701 nt, Artificial Sequence; identical to SEQ ID NO: 185937
  derived and/or modified sequence opt5 from hemagglutinin__InfluenzaA__AEW10774

SEQ ID NO: 190863 - RNA, 1701 nt, Artificial Sequence; identical to SEQ ID NO: 185680
  derived and/or modified sequence opt5 from hemagglutinin__InfluenzaA__AEW10784

SEQ ID NO: 190864 - RNA, 1701 nt, Artificial Sequence; identical to SEQ ID NO: 185680
  derived and/or modified sequence opt5 from hemagglutinin__InfluenzaA__AEW10794

SEQ ID NO: 190865 - RNA, 1701 nt, Artificial Sequence; identical to SEQ ID NO: 185873
  derived and/or modified sequence opt5 from hemagglutinin__InfluenzaA__AEW10804

SEQ ID NO: 190866 - RNA, 1701 nt, Artificial Sequence; identical to SEQ ID NO: 185691
  derived and/or modified sequence opt5 from hemagglutinin__InfluenzaA__AEW10814

SEQ ID NO: 190867 - RNA, 1701 nt, Artificial Sequence; identical to SEQ ID NO: 185784
  derived and/or modified sequence opt5 from hemagglutinin__InfluenzaA__AEW10824

SEQ ID NO: 190868 - RNA, 1701 nt, Artificial Sequence; identical to SEQ ID NO: 185680
  derived and/or modified sequence opt5 from hemagglutinin__InfluenzaA__AEW10834

SEQ ID NO: 190869 - RNA, 1701 nt, Artificial Sequence; identical to SEQ ID NO: 185873
  derived and/or modified sequence opt5 from hemagglutinin__InfluenzaA__AEW10844

SEQ ID NO: 190870 - RNA, 1701 nt, Artificial Sequence
  derived and/or modified sequence opt5 from hemagglutinin__InfluenzaA__AEW10854
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucacaauucggccgaaaguccgcgaucaggaggggagaaugaauuacuauuggacccucguugaacccggagacaagaucacguucgaggcuacaggcaaccugguggugccucgguacgccuuugcgauggaacgcaacgccggguccggaauuaucaucagcgauacccccguccaugacugcaauacaaccugucaaaccccuaaaggcgcuauuaacacaucucugcccuuccagaauauccacccgauuacgaucggcaagugcccuaaguaugugaaaagcaccaagcucagacuggccacagggcuucggaacguucccuccauucagucucgcggacuguuuggcgcuaucgccggguucaucgagggaggcuggaccgggaugguggacggaugguacggcuaucaucaccagaaugaacaaggcagcggguacgccgcugaucucaaauccacacagaacgcgauugacgagaucaccaauaaggucaacagcgugauugagaaaaugaauacgcaguuuacagccguuggaaaggaguucaaccaccuggagaagagaaucgaaaaucuuaacaaaaagguggaugacggcuuccuggauauuuggaccuacaaugcugagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauacauguauggaaagcgugaaaaacggcaccuacgauuauccuaaguacucugaggaagccaaacucaauagagaggagaucgacgggguuaagcuggaauccacacggauuuaucaaauccuugcuauuuacagcacgguggccuccucucugguccucgugguuagccugggcgcgaucuccuuuuggaugugcucuaacggaagccugcagugccgcauuuguaucuga

SEQ ID NO: 190871 - RNA, 1701 nt, Artificial Sequence; identical to SEQ ID NO: 185873
  derived and/or modified sequence opt5 from hemagglutinin__InfluenzaA__AEW10864

SEQ ID NO: 190872 - RNA, 1701 nt, Artificial Sequence; identical to SEQ ID NO: 185873
  derived and/or modified sequence opt5 from hemagglutinin__InfluenzaA__AEW10874

SEQ ID NO: 190873 - RNA, 1701 nt, Artificial Sequence; identical to SEQ ID NO: 185873
  derived and/or modified sequence opt5 from hemagglutinin__InfluenzaA__AEW10884

SEQ ID NO: 190874 - RNA, 1701 nt, Artificial Sequence; identical to SEQ ID NO: 185680
  derived and/or modified sequence opt5 from hemagglutinin__InfluenzaA__AEW10894

SEQ ID NO: 190875 - RNA, 1701 nt, Artificial Sequence; identical to SEQ ID NO: 185873
  derived and/or modified sequence opt5 from hemagglutinin__InfluenzaA__AEW10904

SEQ ID NO: 190876 - RNA, 1701 nt, Artificial Sequence; identical to SEQ ID NO: 185873
  derived and/or modified sequence opt5 from hemagglutinin__InfluenzaA__AEW10914

SEQ ID NO: 190877 - RNA, 1701 nt, Artificial Sequence; identical to SEQ ID NO: 185680
  derived and/or modified sequence opt5 from hemagglutinin__InfluenzaA__AEW10924

SEQ ID NO: 190878 - RNA, 1701 nt, Artificial Sequence; identical to SEQ ID NO: 185680
  derived and/or modified sequence opt5 from hemagglutinin__InfluenzaA__AEW10934

SEQ ID NO: 190879 - RNA, 1701 nt, Artificial Sequence; identical to SEQ ID NO: 185873
  derived and/or modified sequence opt5 from hemagglutinin__InfluenzaA__AEW10944

SEQ ID NO: 190880 - RNA, 1701 nt, Artificial Sequence; identical to SEQ ID NO: 185693
  derived and/or modified sequence opt5 from hemagglutinin__InfluenzaA__AEW10954

SEQ ID NO: 190881 - RNA, 1701 nt, Artificial Sequence; identical to SEQ ID NO: 185693
  derived and/or modified sequence opt5 from hemagglutinin__InfluenzaA__AEW10964

SEQ ID NO: 190882 - RNA, 1701 nt, Artificial Sequence; identical to SEQ ID NO: 185873
  derived and/or modified sequence opt5 from hemagglutinin__InfluenzaA__AEW10974

SEQ ID NO: 190883 - RNA, 1701 nt, Artificial Sequence; identical to SEQ ID NO: 185693
  derived and/or modified sequence opt5 from hemagglutinin__InfluenzaA__AEW10984

SEQ ID NO: 190884 - RNA, 1701 nt, Artificial Sequence; identical to SEQ ID NO: 185693
  derived and/or modified sequence opt5 from hemagglutinin__InfluenzaA__AEW10994

SEQ ID NO: 190885 - RNA, 1701 nt, Artificial Sequence; identical to SEQ ID NO: 185693
  derived and/or modified sequence opt5 from hemagglutinin__InfluenzaA__AEW11004

SEQ ID NO: 190886 - RNA, 1701 nt, Artificial Sequence; identical to SEQ ID NO: 185693
  derived and/or modified sequence opt5 from hemagglutinin__InfluenzaA__AEW11014

SEQ ID NO: 190887 - RNA, 1701 nt, Artificial Sequence; identical to SEQ ID NO: 185693
  derived and/or modified sequence opt5 from hemagglutinin__InfluenzaA__AEW11024

SEQ ID NO: 190888 - RNA, 1701 nt, Artificial Sequence; identical to SEQ ID NO: 185693
  derived and/or modified sequence opt5 from hemagglutinin__InfluenzaA__AEW11034

SEQ ID NO: 190889 - RNA, 1701 nt, Artificial Sequence; identical to SEQ ID NO: 185873
  derived and/or modified sequence opt5 from hemagglutinin__InfluenzaA__AEW11044

SEQ ID NO: 190890 - RNA, 1701 nt, Artificial Sequence; identical to SEQ ID NO: 185693
  derived and/or modified sequence opt5 from hemagglutinin__InfluenzaA__AEW11054

SEQ ID NO: 190891 - RNA, 1701 nt, Artificial Sequence; identical to SEQ ID NO: 185680
  derived and/or modified sequence opt5 from hemagglutinin__InfluenzaA__AEW11064

SEQ ID NO: 190892 - RNA, 1701 nt, Artificial Sequence; identical to SEQ ID NO: 185680
  derived and/or modified sequence opt5 from hemagglutinin__InfluenzaA__AEW11074

SEQ ID NO: 190893 - RNA, 1701 nt, Artificial Sequence
  derived and/or modified sequence opt5 from hemagglutinin__InfluenzaA__AEW11084
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccaccucugccgaucaacagagccuguaccagaacgcugacgccuacguguucgugggcuccagcagauauucuaagaaauuuaagcccgagauugcuauccggccuaaaguccgcgaucaggaggggagaaugaauuacuauuggacacugguugaaccgggagacaagauuaccuucgaggccacgggcaaccucguggugccccgguacgcguuugccauggaacgcaacgcuggguccggaaucauuaucagcgauacaccuguccaugacugcaauaccacaugucaaacccccaaaggcgccaucaacaccucucugccuuuccagaauauucaccccaucacaauuggcaagugcccgaaguaugugaaaagcacgaaacuuagacuggcuaccgggcuccggaacguuccuuccauccagucucgcggacuguuuggcgccauugccggguucaucgagggaggcuggacagggaugguggacggaugguacggcuaucaucaccagaaugaacaaggcagcggguacgcugcggaucuuaaguccacccagaacgccaucgacgagauuacaaauaaggucaacagcgugaucgagaaaaugaauacccaguuuacggcuguuggaaaggaguucaaccaccuggagaagagaauugaaaaucucaacaaaaagguggaugacggcuuccuggauaucuggacauacaaugccgagcugcucguccugcuugaaaacgagcggacccuggacuaucaugauucuaaugugaaaaaccucuacgagaagguccgcucccagcugaaaaacaaugccaaggaaauugggaacggauguuuugaguucuaucacaagugcgacaauaccuguauggaaagcgugaaaaacggcacauacgauuaucccaaguacucugaggaagcuaaacuuaauagagaggagaucgacgggguuaagcuggaauccacccggaucuaucaaauucucgccaucuacagcacaguggcguccucucugguccuggugguuagccucggcgcuauuuccuuuuggaugugcucuaacggaagccugcagugccgcaucuguauuuga

SEQ ID NO: 190894 - RNA, 1701 nt, Artificial Sequence; identical to SEQ ID NO: 185680
  derived and/or modified sequence opt5 from hemagglutinin__InfluenzaA__AEW11094

SEQ ID NO: 190895 - RNA, 1701 nt, Artificial Sequence; identical to SEQ ID NO: 185680
  derived and/or modified sequence opt5 from hemagglutinin__InfluenzaA__AEW11104

SEQ ID NO: 190896 - RNA, 1701 nt, Artificial Sequence; identical to SEQ ID NO: 185693
  derived and/or modified sequence opt5 from hemagglutinin__InfluenzaA__AEW11114

SEQ ID NO: 190897 - RNA, 1701 nt, Artificial Sequence
  derived and/or modified sequence opt5 from hemagglutinin__InfluenzaA__AEW11124
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguuugugaaaagcacgaagcugagacuugcuaccgggcugcggaacguucccuccauccagucucgcggacucuucggcgccauugccggguuuaucgagggaggcuggacagggaugguggacggaugguauggcuaccaucaccagaaugaacaaggcagcggguaugcugcggaucugaaauccacccagaacgccaucgacgagauuacaaauaaggucaacagcgugaucgagaaaaugaauacccaguucacggcuguuggaaaggaguucaaccaccuugagaagagaauugaaaaucugaacaaaaagguggaugacggcuuucucgauaucuggacauacaaugccgagcugcugguccuccuggaaaacgagcggacccuugacuaccaugauucuaaugugaaaaaccuguaugagaagguccgcucccagcucaaaaacaaugccaaggaaauugggaacggauguuucgaguuuuaccacaagugcgacaauaccuguauggaaagcgugaaaaacggcacauaugauuacccuaaguauucugaggaagcuaaacugaauagagaggagaucgacgggguuaaacuugaauccacccggaucuaccaaauucuggccaucuauagcacaguggcguccucucucguccuggugguuagccugggcgcuauuuccuucuggaugugcucuaacggaagccuccagugccgcaucuguauuuga

SEQ ID NO: 190898 - RNA, 1701 nt, Artificial Sequence
  derived and/or modified sequence opt5 from hemagglutinin__InfluenzaA__AEW11134
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauaaggaggagaucgacgggguuaaacuggaauccaccagaauuuaucaaauccuugccauuuacagcacaguggcguccucucugguccucgugguuagccugggcgcuaucuccuuuuggaugugcucuaacggaagccugcagugccggauuuguaucuga

SEQ ID NO: 190899 - RNA, 1701 nt, Artificial Sequence; identical to SEQ ID NO: 185693
  derived and/or modified sequence opt5 from hemagglutinin__InfluenzaA__AEW11144

SEQ ID NO: 190900 - RNA, 1701 nt, Artificial Sequence; identical to SEQ ID NO: 185693
  derived and/or modified sequence opt5 from hemagglutinin__InfluenzaA__AEW11154

SEQ ID NO: 190901 - RNA, 1701 nt, Artificial Sequence; identical to SEQ ID NO: 190893
  derived and/or modified sequence opt5 from hemagglutinin__InfluenzaA__AEW11164

SEQ ID NO: 190902 - RNA, 1701 nt, Artificial Sequence; identical to SEQ ID NO: 190893
  derived and/or modified sequence opt5 from hemagglutinin__InfluenzaA__AEW11174

SEQ ID NO: 190903 - RNA, 1701 nt, Artificial Sequence; identical to SEQ ID NO: 185693
  derived and/or modified sequence opt5 from hemagglutinin__InfluenzaA__AEW11184

SEQ ID NO: 190904 - RNA, 1701 nt, Artificial Sequence; identical to SEQ ID NO: 185680
  derived and/or modified sequence opt5 from hemagglutinin__InfluenzaA__AEW11194

SEQ ID NO: 190905 - RNA, 1701 nt, Artificial Sequence; identical to SEQ ID NO: 185693
  derived and/or modified sequence opt5 from hemagglutinin__InfluenzaA__AEW11204

SEQ ID NO: 190906 - RNA, 1701 nt, Artificial Sequence; identical to SEQ ID NO: 185693
  derived and/or modified sequence opt5 from hemagglutinin__InfluenzaA__AEW11214

SEQ ID NO: 190907 - RNA, 1701 nt, Artificial Sequence; identical to SEQ ID NO: 185873
  derived and/or modified sequence opt5 from hemagglutinin__InfluenzaA__AEW11224

SEQ ID NO: 190908 - RNA, 1701 nt, Artificial Sequence; identical to SEQ ID NO: 185693
  derived and/or modified sequence opt5 from hemagglutinin__InfluenzaA__AEW11234

SEQ ID NO: 190909 - RNA, 1701 nt, Artificial Sequence; identical to SEQ ID NO: 185693
  derived and/or modified sequence opt5 from hemagglutinin__InfluenzaA__AEW11244

SEQ ID NO: 190910 - RNA, 1701 nt, Artificial Sequence
  derived and/or modified sequence opt5 from hemagglutinin__InfluenzaA__AEW11254
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuugucugcaugccggcgcgaaaucuuuuuauaagaaucucaucuggcugguuaaaaagggcaacagcuaccccaaacuuuccaagagcuauauuaaugacaaggggaaagaagugcugguccucuggggaauccaccacccuuccgccucugcugaucaacagagccuguaccagaacgccgacgcuuacguguucgugggcuccagcagauauucuaagaaagucaagcccgagauugccauccggccuaaaguucgcgaucaggaggggagaaugaauuacuauuggacccugguggaaccgggagacaagauuacauuugaggcgaccggcaaccucguggucccccgguacgccuucgcuauggaacgcaacgccggguccggaaucauuaucagcgauacgccugugcaugacugcaauacaaccugucaaacacccaaaggcgcuaucaacaccucucugccuuuucagaauauucaccccaucaccauuggcaagugcccgaaguauguuaaaagcacaaaacuuagacuggccacggggcuccggaacgugccuuccauccagucucgcggacuguucggcgccauugcuggguuuaucgagggaggcuggaccgggauggucgacggaugguacggcuaucaucaccagaaugaacaaggcagcggguacgcggccgaucuuaaguccacacagaacgcuaucgacgagauuaccaauaaggugaacagcguuaucgagaaaaugaauacacaguucaccgccgugggaaaggaauuuaaccaccuggagaagagaauugaaaaucucaacaaaaaggucgaugacggcuuccuggauaucuggacguacaaugccgagcugcucgugcugcuugaaaacgagcggacacuggacuaucaugauucuaaugucaaaaaccucuacgagaaggugcgcucccagcugaaaaacaaugcuaaggaaauugggaacggauguuucgaguuuuaucacaagugcgacaauaccuguauggaaagcguuaaaaacggcaccuacgauuaucccaaguacucugaggaagccaaacuuaauagagaggagaucgacggggugaagcuggaauccacacggaucuaucaaauucucgcgaucuacagcaccgucgcuuccucucuggugcugguugugagccucggcgccauuuccuucuggaugugcucuaacggaagccugcagugccgcaucuguauuuga

SEQ ID NO: 190911 - RNA, 1701 nt, Artificial Sequence; identical to SEQ ID NO: 185680
  derived and/or modified sequence opt5 from hemagglutinin__InfluenzaA__AEW11263

SEQ ID NO: 190912 - RNA, 1701 nt, Artificial Sequence; identical to SEQ ID NO: 185680
  derived and/or modified sequence opt5 from hemagglutinin__InfluenzaA__AEW11273

SEQ ID NO: 190913 - RNA, 1701 nt, Artificial Sequence; identical to SEQ ID NO: 185680
  derived and/or modified sequence opt5 from hemagglutinin__InfluenzaA__AEW11283

SEQ ID NO: 190914 - RNA, 1701 nt, Artificial Sequence; identical to SEQ ID NO: 185680
  derived and/or modified sequence opt5 from hemagglutinin__InfluenzaA__AEW11293

SEQ ID NO: 190915 - RNA, 1701 nt, Artificial Sequence
  derived and/or modified sequence opt5 from hemagglutinin__InfluenzaA__AEW11303
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcguguguaucuga

SEQ ID NO: 190916 - RNA, 1701 nt, Artificial Sequence; identical to SEQ ID NO: 185680
  derived and/or modified sequence opt5 from hemagglutinin__InfluenzaA__AEW11313

SEQ ID NO: 190917 - RNA, 1701 nt, Artificial Sequence
  derived and/or modified sequence opt5 from hemagglutinin__InfluenzaA__AEW11323
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccgugaacacaagccuccccuuccagaauauccacccgauuacgaucgggaagugcccuaaguauguuaaaucuaccaagcugagacuugcuacaggacugcggaacgugcccagcauucagucccgcggccucuuuggggccaucgccggauucauugagggcggguggaccggaauggucgacggcugguacggcuaucaucaccagaaugaacaagggucuggauacgcugcggaccugaaaagcacacagaacgccaucgaugagaucaccaauaaggugaacuccguuauugagaaaaugaauacgcaguuuacagcugugggcaaggaguucaaccaccuugagaagagaaucgaaaaucugaacaaaaaggucgacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccguuaaaaacgggaccuacgacuauccuaaguacagcgaggaagcuaaacugaauagagaggagauugauggcgugaaacuugaaucuacacggaucuaucaaauccuggccauuuacuccacggucgcgagcucccucgugcugguugugucucugggagcuaucagcuuuuggaugugcuccaacggcucucuccagugccgcauuuguaucuga

SEQ ID NO: 190918 - RNA, 1701 nt, Artificial Sequence
  derived and/or modified sequence opt5 from hemagglutinin__InfluenzaA__AEW22712
augaaggccauccuggugguccuccuguacaccuucgcuacagccaacgcggacacgcuuugcauuggcuaucacgcuaauaacagcaccgauacaaucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaggaacugcgggagcagcuuuccagcgugucuuccuucgaacgcuuugagaucuuccccaagaccagcucuuggccuaaucacgauuccaacaagggagucacagccgcuuguccccaugccggcgcgaaaggcuuuuauaagaaucugauuuggcucgugaaaaaggggaacagcuacccuaaacugucuaaguccuauaucaaugacaagggaaaagaaguucuugugcuguggggcauucaccaccccagcaccacagccgaucaacagucccucuaccagaacgcugacaccuacgucuucguggggacgucuagauauagcaagaaauuuaagccugagaucgccauucggccgaaagugcgcgaucaggagggaagaaugaauuacuauuggacacuggucaagcccggcgacaaaaucaccuucgaagcuacagggaaccugguugugccucgguacgccuuugcgauggagcgcaacgccggauccggcauuaucaucagcgauacccccgugcaugacugcaauaccacaugucaaacgccuaagggcgcuauuaacaccucucuccccuuccagaauauccacccgauuacaaucgggaagugcccuaaauaugucaaguccaccaaacugagacuugccacaggacugcggaacgugcccagcauucagucucgcggccucuuuggggcuaucgccggauucaucgaaggcggguggaccggaaugguugacggcugguacggcuaucaucaccagaaugagcaagggagcggauacgccgcugaucugaaguccacgcagaacgcgauugacaaaaucacaaauaaggugaacucugucauugaaaagaugaauacccaguuuaccgccgugggcaaagaguucaaccaccuugagaagagaaucgaaaaucugaacaaaaagguugaugacggguuccucgauauuuggacauacaaugcugagcugcuggugcuccuggaaaacgagcggacccuugacuaucaugauagcaaugucaaaaaccuguacgaaaaggugcgcaaccagcucaagaauaacgccaaagagaucggaaauggcuguuuugaguucuaucacaagugcgacaacacauguauggaauccgucaaaaaugggacguacgauuauccuaaguacagcgaggaagccaaacugaacagagaggaaaucgacggcgugaaacuugagucuacccggauuuaucaaauccuggcuauuuacuccacaguugccagcucucucgugcuggucgugucccugggagcgaucagcuuuuggaugugcuccaauggcucucuccagugccgcauuuguaucuga

SEQ ID NO: 190919 - RNA, 1701 nt, Artificial Sequence
  derived and/or modified sequence opt5 from hemagglutinin__InfluenzaA__AEW22718
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguuaagcccggcgacaaaauuaccuucgaagcuacagggaaccugguggugccucgguacgccuuugcgauggagcgcaacgccggauccggcaucauuaucagcgauacccccguccaugacugcaauaccacaugucaaacgccuaagggcgcuaucaacaccucucuccccuuccagaauauucacccgaucacaauugggaagugcccuaaauaugugaaguccaccaaacugagacuugccacaggacugcggaacguucccagcauccagucucgcggccucuuuggggcuauugccggauucaucgaaggcggguggaccggaaugguggacggcugguacggcuaucaucaccagaaugagcaagggagcggauacgccgcugaucugaaguccacgcagaacgcgaucgacaaaauuacaaauaaggucaacucugugaucgaaaagaugaauacccaguuuaccgccguuggcaaagaguucaaccaccuugagaagagaauugaaaaucugaacaaaaagguggaugacggguuccucgauaucuggacauacaaugcugagcugcugguccuccuggaaaacgagcggacccuugacuaucaugauagcaaugugaaaaaccuguacgaaaagguccgcaaccagcucaagaauaacgccaaagagauuggaaauggcuguuuugaguucuaucacaagugcgacaacacauguauggaauccgugaaaaaugggacguacgauuauccuaaguacagcgaggaagccaaacugaacagagaggaaaucgacggcguuaaacuugagucuacccggaucuaucaaauucuggcuaucuacuccacaguggccagcucucucguccuggugguuucccugggagcgauuagcuuuuggaugugcuccaauggcucucuccagugccgcaucuguauuuga

SEQ ID NO: 190920 - RNA, 1701 nt, Artificial Sequence; identical to SEQ ID NO: 189478
  derived and/or modified sequence opt5 from hemagglutinin__InfluenzaA__AEW22720

SEQ ID NO: 190921 - RNA, 1701 nt, Artificial Sequence; identical to SEQ ID NO: 189478
  derived and/or modified sequence opt5 from hemagglutinin__InfluenzaA__AEW22722

SEQ ID NO: 190922 - RNA, 1701 nt, Artificial Sequence
  derived and/or modified sequence opt5 from hemagglutinin__InfluenzaA__AEW22724
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugaaaagagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccagagagauuggaaauggcuguuuugaguucuaucacaagugcgacaacacauguauggaguccgugaaaaaugggacguacgauuauccuaaguacagcgaagaggccaaacugaaccgggaagagaucgacggcguuaaacuugagucuacccgcaucuaucaaauucuggcuaucuacuccacaguggccagcucucucguccuggugguuucccugggagcgauuagcuuuuggaugugcuccaauggcucucuccagugcagaaucuguauuuga

SEQ ID NO: 190923 - RNA, 1701 nt, Artificial Sequence
  derived and/or modified sequence opt5 from hemagglutinin__InfluenzaA__AEW25297
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauuccuggaaauccggagugugaaucucugagcacagccuccucuuggagcuacaucguggagaccuccucuagcgacaacggcacgugcuaucccggggauuuuauugacuacgaagaacuccgggagcagcuguccagcgucucuuccuucgaacgcuuugagaucuucccuaagaccagcucuuggcccaaucacgauccuaacaagggagugacagccgcuuguccccaugccggcgcgaaauccuuuuauaagaaucuuaucuggcugguuaaaaagggcaacagcuacccuaaacucucuaaguccuauauuaaugacaaggggaaagaagugcugguccuuuggggaauccaccacccgagcaccuccgccgaucaacagucucuguaccagaacgcugacgccuacguguucgugggcacaagcagauauuccaagaaauuuaagcccgagauugcuauccggccuaaaguccgcgaucaggaggggagaaugaauuacuauuggacccucguugaacccggagacaagauuacguucgaggccacaggcaaccugguggugccucgguacgcguuugccauggaacgcaacgcugggagcggaaucauuaucucugauacccccguccaugacugcaauacaaccugucaaaccccgagaggcgccaucaacacaucccugccuuuccagaauauucaccccaucacgauuggcaaaugcccuaaguauguuaagagcaccaaacuccggcuggcuacagggcuucgcaacgugcccucuauccagagcagaggacuguuuggcgccauugccggguucaucgagggaggcuggaccgggaugguggacggaugguacggcuaucaucaccagaaugaacaaggcuccggguacgcugcggaucucaagucuacacagaacgccaucgacgagauuaccaauaaagucaacagcgugaucgagaagaugaauacgcaguuuacagcuguuggaaaagaguucaaccaccuggagaagcggauugaaaaucuuaacaagaaaguggaugacggcuuccuggauaucuggaccuacaaugccgagcuccugguccugcucgaaaacgagcgcacccuggacuaucaugauuccaaugugaagaaccuuuacgagaaagucagaagccagcugaagaacaaugccaaagaaauugggaacggauguuuugaguucuaucacaagugcgacaauacauguauggaaucugugaagaacggcaccuacgauuaucccaaauacuccgaggaagcuaagcucaaucgggaggagaucgacgggguuaaacuggaaagcacacgcaucuaucaaauucuugccaucuacucuacgguggcguccagccugguccucgugguuucccugggcgcuauuucuuuuuggaugugcagcaacggaucccugcagugcagaaucuguauuuga

SEQ ID NO: 190924 - RNA, 1701 nt, Artificial Sequence; identical to SEQ ID NO: 186491
  derived and/or modified sequence opt5 from hemagglutinin__InfluenzaA__AEW25306

SEQ ID NO: 190925 - RNA, 1701 nt, Artificial Sequence
  derived and/or modified sequence opt5 from hemagglutinin__InfluenzaA__AEW25315
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaauagagaggagaucgacgggguuaaacuugaaagcacacggaucuaucaaauucuggccaucuacucuacgguggcguccagccucguccuggugguuucccugggcgcuauuucuuuuugggugugcagcaacggaucccuccagugccgcaucuguauuuga

SEQ ID NO: 190926 - RNA, 1701 nt, Artificial Sequence
  derived and/or modified sequence opt5 from hemagglutinin__InfluenzaA__AEW25331
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccucuagcuccgacaacggcacgugcuauccgggggauuucauugacuacgaagaacuccgggagcagcugagcucugucuccagcuuugaacgcuucgagaucuuucccaagaccucuuccuggccuaaucacgauagcaacaagggagugacagccgccuguccccaugcuggcgccaaaucuuucuauaagaaucuuaucuggcugguuaaaaagggcaacuccuacccuaaacucagcaaguccuauauuaaugacaaggggaaagaagugcugguccuuuggggaauccaccaccccucuaccagcgcggaucaacagucccuguaccagaacgccgacgcuuacguguuugugggcacaagcagauauucuaagaaauucaagccugagauugccauccggccgaaaguccgcgaucaggaggggagaaugaauuacuauuggacccucguugaacccggagacaagauuacguuugaggcuacaggcaaccugguggugccucgguacgccuucgcgauggaacgcaacgccggguccggaaucauuaucagcgauacccccguccaugacugcaauacaaccugucaaaccccuaaaggcgcuaucaacacaucucugcccuuucagaauauuccgccuaucacgauuggcaagugccccaaguaugugaaaagcaccaagcucagacuggccacagggcuucggaacguuccuuccauccagucucgcggacuguucggcgcuauugccggguuuaucgagggaggcuggaccgggaugguggacggaugguacggcuaucaccaucagaaugaacaaggcagcggguacgccgcugaucucaaauccacacagaacgcgaucgacgagauuaccaauaaggucaacagcgugaucgagaaaaugaauacgcaguucacagccguuggaaaggaguucaaccaccuggagaagagaauugaaaaucuuaacaaaaagguggaugacggcuuucuggauaucuggaccuacaaugcugagcuccugguccugcucgaaaacgagcggacccuggacuaucacgauucuaaugugaaaaaccuuuacgagaagguccgcucccagcugaaaaacaaugccaaggaaauugggaacggauguuucgaguuuuaucauaagugcgacaauacauguauggaaagcgugaaaaacggcaccuacgauuaucccaaguacucugaggaagccaaacucaauagagaggagaucgacgggguuaagcuggaauccacacggaucuaucaaauucuugcuaucuacagcacgguggccuccucucugguccucgugguuagccugggcgcgauuuccuucuggaugugcucuaacggaagccugcagugccgcaucuguauuuga

SEQ ID NO: 190927 - RNA, 1701 nt, Artificial Sequence
  derived and/or modified sequence opt5 from hemagglutinin__InfluenzaA__AEW25349
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccucuagcuccgacaacggcacgugcuauccgggggauuucauugacuacgaagaacuccgggagcagcugagcucugucuccagcuuugaacgcuucgagaucuuucccaagaccucuuccuggccuaaucacgauagcaacaagggagugacagccgccuguccccaugcuggcgccaaaucuuucuauaagaaucuuaucuggcugguuaaaaagggcaacuccuacccuaaacucagcaaguccuauauuaaugacaaggggaaagaagugcugguccuuuggggaauccaccaccccucuaccagcgcggaucaacagucccuguaccagaacgccgacgcuuacguguuugugggcacaagcagauauucuaagaaauucaagccugagauugccauccggccgaaaguccgcgaucaggaggggagaaugaauuacuauuggacccucguugaacccggagacaagauuacguuugaggcuacaggcaaccugguggugccucgguacgccuucgcgauggaacgcaacgccggguccggaaucauuaucagcgauacccccguccaugacugcaauacaaccugucaaaccccuaaaggcgcuaucaacacaucucugcccuuucagaauauucacccgaucacgauuggcaagugcccuaaguaugugaaaagcaccaagcucagacuggccacagggcuucggaacguucccuccauccagucucgcggacuguucggcgcuauugccggguuuaucgagggaggcuggaccgggaugguggacggaugguacggcuaucaucaccagaaugaacaaggcagcggguacgccgcugaucucaaauccacacagaacgcgaucgacgagauuaccaauaaggucaacagcgugaucgagaaaaugaauacgcaguucacagccguuggaaaggaguucaaccaccuggagaagagaauugaaaaucuuaacaaaaagguggaugacggcuuucuggauaucuggaccuacaaugcugagcuccugguccugcucgaaaacgagcggacccuggacuaucaugauucuaaugugaaaaaccuuuacgagaagguccgcucccagcugaaaaacaaugccaaggaaauugggaacggauguuucgaguuuuaucacaagugcgacaauacauguauggaaagcgugaaaaacggcaccuacgauuauccuaaguacucugaggaagccaaacucaauagagaggagaucgacgggguuaagcuggaauccacacggaucuaucaaauucuugcuaucuacagcacgguggccuccucucugguccucgugguuagccugggcgcgauuuccuucuggaugugcucuaacggaagccugcagugccgcaucuguauuuga

SEQ ID NO: 190928 - RNA, 1701 nt, Artificial Sequence
  derived and/or modified sequence opt5 from hemagglutinin__InfluenzaA__AEW25367
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccucuagcuccgacaacggcacgugcuauccgggggauuucauugacuacgaagaacuccgggagcagcugagcucugucuccagcuuugaacgcuucgagaucuuucccaagaccucuuccuggccuaaucacgauagcaacaagggagugacagccgccuguccccaugcuggcgccaaaucuuucuauaagaaucuuaucuggcugguuaaaaagggcaacuccuacccuaaacucagcaaguccuauauuaaugacaaggggaaagaagugcugguccuuuggggaauccaccaccccucuaccagcgcggaucaacagagacuguaccagaacgccgacgcuuacguguuugugggcacaucccgguauagcaagaaauucaagccugagauugccauccgcccgaaagucagagaucaggaggggcggaugaauuacuauuggacccucguugaacccggagacaagauuacguuugaggcuacaggcaaccugguggugccucgcuacgccuucgcgauggaaagaaacgccgggucuggaaucauuaucuccgauacccccguccaugacugcaauacaaccugucaaaccccuaaaggcgcuaucaacacaagccugcccuuucagaauauucacccgaucacgauuggcaagugcccuaaguaugugaaaucuaccaagcuccggcuggccacagggcuucgcaacguucccagcauccaguccagaggacuguucggcgcuauugccggguuuaucgagggaggcuggaccgggaugguggacggaugguacggcuaucaucaccagaaugaacaaggcucuggguacacagccgaucucaaaagcacccagaacgcuaucgacgagauuacgaauaaggucaacuccgugaucgagaaaaugaauacacaguucaccgcgguuggaaaggaguucaaccaccuggagaagcggauugaaaaucuuaacaaaaagguggaugacggcuuucuggauaucuggaccuacaaugccgagcuccugguccugcucgaaaacgagcgcacacuggacuaucaugauagcaaugugaaaaaccuuuacgagaaggucagaucucagcugaaaaacaaugcuaaggaaauugggaacggauguuucgaguuuuaucacaagugcgacaauaccuguauggaauccgugaaaaacggcacauacgauuauccuaaguacagcgaggaagccaaacucaaucgggaggagaucgacgggguuaagcuggaaucuacgcgcaucuaucaaauucuugccaucuacuccaccguggcuagcucccugguccucgugguuucucugggcgccauuagcuucuggaugugcuccaacggaucucugcagugcagaaucuguauuuga

SEQ ID NO: 190929 - RNA, 1701 nt, Artificial Sequence
  derived and/or modified sequence opt5 from hemagglutinin__InfluenzaA__AEW25377
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaaggucaaaucucagcucaagaacaaugccaaggaaauugggaacggauguuuugaguucuaucacaaaugcgacaaugccuguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 190930 - RNA, 1701 nt, Artificial Sequence
  derived and/or modified sequence opt5 from hemagglutinin__InfluenzaA__AEW25385
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcguccccucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggaaucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190931 - RNA, 1701 nt, Artificial Sequence; identical to SEQ ID NO: 190927
  derived and/or modified sequence opt5 from hemagglutinin__InfluenzaA__AEW25416

SEQ ID NO: 190932 - RNA, 1701 nt, Artificial Sequence
  derived and/or modified sequence opt5 from hemagglutinin__InfluenzaA__AEW25446
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauaagcaguuuacggcuguuggaaaggaguucaaccaccuugagaaaagaauugaaaaucugaacaagaaaguggaugacggcuuccucgauaucuggacauacaaugccgagcugcugguccuccuggaaaacgagcggacccuugacuaucaugauuccaaugugaagaaccuguacgagaaaguccgcagccagcucaagaacaaugccaaggaaauugggaacggauguuuugaguucuaucacaaaugcgacaauaccuguauggaaucugugaagaacggcacauacgauuaucccaaauacuccgaggaagcuaagcugaauagagaggagaucgacgggguuaaacuugaaagcacccggaucuaucaaauucuggccaucuacucuacaguggcguccagccucguccuggugguuucccugggcgcuauuucuuuuuggaugugcagcaacggaucccuccagugccgcaucuguauuuga

SEQ ID NO: 190933 - RNA, 1701 nt, Artificial Sequence; identical to SEQ ID NO: 190927
  derived and/or modified sequence opt5 from hemagglutinin__InfluenzaA__AEW25454

SEQ ID NO: 190934 - RNA, 1701 nt, Artificial Sequence
  derived and/or modified sequence opt5 from hemagglutinin__InfluenzaA__AEW25462
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaagccuuauaccaaugacaaggggaaagaagugcuuguccuguggggcauucaccacccguccacaagcgccgaucaacagucccucuaccagaacgcugacgccuacguguucgugggaaccucuagauauagcaagaaauuuaagcccgagaucgcuauucggccuaaaguccgcgaucaggaggggagaaugaauuacuauuggacgcugguugaacccggagacaagaucacauucgaggccaccggcaaccugguggugccucgguacgcguuugccauggaacgcaacgcuggguccggaauuaucauuagcgauacacccguccaugacugcaauaccaccugucaaacaccgaaaggcgccaucaacacgucucucccuuuccagaauauccaccccauuaccaucggcaagugcccuaaguaugugaaauccacaaagcugagacuugcuaccgggcugcggaacguucccagcauucagucucgcggacucuuuggcgccaucgccggguucauugagggaggcuggacagggaugguggacggaugguacggcuaucaucaccagaaugaacaaggcagcggguacgcugcggaucugaaauccacccagaacgccaucgacgagaucacgaauaaggucaacucugugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucccagcucaaaaacaaugccaaggaaaucgggaacggauguuuugaguucuaucacaagugcgacaauaccuguauggaaagcgugaaaaacggcacauacgauuaucccaaguacucugaggaagcuaaacugaauagagaggagauugacgggguuaaacuugaauccacgcggaucuaucaaauccuggccauuuacagcaccguggcgucuucccucguccuggugguuagccugggcgcuaucuccuuuuggaugugcucuaacggaagccuccagugccgcauuuguaucuga

SEQ ID NO: 190935 - RNA, 1701 nt, Artificial Sequence; identical to SEQ ID NO: 186491
  derived and/or modified sequence opt5 from hemagglutinin__InfluenzaA__AEW25472

SEQ ID NO: 190936 - RNA, 1701 nt, Artificial Sequence
  derived and/or modified sequence opt5 from hemagglutinin__InfluenzaA__AEW25482
augaaggccauccuggugguccuccuguacaccuucgcuacagccaacgcggacacgcuuugcauuggcuaucacgcuaauaacagcaccgauacaguugacaccgugcuggagaaaaaggugacagucacccauuccgugaaucuccuggaagauaaacacaacgggaaacuuuguaaacugagaggaguugcuccccuccaucugggcaagugcaauaucgccggguggauucugggaaacccugagugugaaucucucagcacagccuccucuuggagcuacaucguggagaccuccaauucugacaacggcacgugcuauccgggggauuuuauugacuacgaggaacugcgggagcagcuuagcuccgucagcucuuucgaacgcuuugagaucuuccccaagaccuccagcuggccuaaucacgaucccaacaaaggagugacagccgcuuguccucaugccggcgcgaagucuuuuuauaaaaaucugaucuggcucguuaagaaaggcaacuccuaccccaagcugagcaagucuuauauuaaugacaaagggaaggaagugcuuguccuguggggaauccaccacccuuccaccagcgccgaucaacagucccucuaccagaacgcugacgccuacguguucgugggcacaucuagauauagcaaaaaguuuaaaccggagauugcuauccggcccaagguccgcgaucaagggggaagaaugaauuacuauuggacccugguugagccuggcgacaaaauuacguucgaagccacagggaaccugguggugccccgguacgcguuugccauggagcgcaacgcuggauccggcaucauuaucagcgauaccccuguccaugacugcaauacaaccugucagacccccaagggcgccaucaacacaucucucccguuccagaauauucacccuaucacgauugggaagugccccaaauaugugaaguccaccaaacugagacuugcuacaggacugcggaacguuccuagcauccagucucgcggccucuuuggggccauugccggauucaucgaaggcggguggaccggaaugguggacggcugguacggcuaucaucaccagaaugagcaagggagcggauacgcugcggaucugaaguccacacagaacgccaucgacgaaauuaccaauaaagucaacucugugaucgagaagaugaauacgcaguuuacagcuguuggcaaggaguucaaccaccuugaaaagagaauugagaaucugaacaagaaaguggaugacggguuccucgauaucuggaccuacaaugccgaacugcugguccuccuggagaacgaacggacccuugacuaucaugauagcaaugugaagaaccuguacgagaaaguccgcucccagcucaagaacaaugccaaggagauuggaaacggcuguuuugaacuguaucacaaaugcgacaauacauguauggagagcgugaagaacgggaccuacgauuaucccaaauacucugaagaggcuaaacuuaauagagaagagaucgacggcguuaagcuggaguccacacggaucuaucaaauucucgccaucuacagcacgguggcgucuucccugguccuggugguuagccucggagcuauuuccuucuggaugugcucuaacggcagccugcagugccgcaucuguauuuga

SEQ ID NO: 190937 - RNA, 1701 nt, Artificial Sequence
  derived and/or modified sequence opt5 from hemagglutinin__InfluenzaA__AEW25492
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacauuuucgugggcacaagcagauauuccaagaaauuuaagccggagaucgcuauucggcccaaagugcgcgaucaggaggggagaaugaauuacuauuggacccuggucgaaccuggagacaagaucacguucgaggccacaggcaaccugguugugccccgguacgcguuugccauggaacgcaacgcugggagcggaauuaucaucucugauaccccugugcaugacugcaauacaaccugucaaacccccaaaggcgccauuaacacaucccucccguuccagaauauccacccuauuacgaucggcaagugccccaaguaugucaaaagcaccaagcugagacuugcuacagggcugcggaacgugccuucuauucagagccgcggacucuuuggcgccaucgccggguucaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucugucaaaaacggcaccuacgauuaucccaaguacuccgaggaagcuaaacugaauagagaggagaucgacggggugaaacuugaaagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 190938 - RNA, 1701 nt, Artificial Sequence
  derived and/or modified sequence opt5 from hemagglutinin__InfluenzaA__AEW25501
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucugccucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacuguaauacaaccugccaaaccccuaagggcgccaucaacacaagccuccccuuccagaauauucacccgaucacgauuggcaaguguccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagaacaaugccaaagagauugggaacggaugcuuugaguucuaucacaagugugacaauacaugcauggaguccgugaaaaacggcaccuacgauuauccuaaguacagcgaagaggcuaaacugaaucgcgaagagaucgacgggguuaagcuggagucuacaagaaucuaucaaauucuggccaucuacuccacgguggcgagcucccucguccuggugguuucucugggcgcuauuagcuuuuggaugugcuccaacggaucucuccagugucggaucugcauuuga

SEQ ID NO: 190939 - RNA, 1701 nt, Artificial Sequence; identical to SEQ ID NO: 190927
  derived and/or modified sequence opt5 from hemagglutinin__InfluenzaA__AEW25509

SEQ ID NO: 190940 - RNA, 1701 nt, Artificial Sequence
  derived and/or modified sequence opt5 from hemagglutinin__InfluenzaA__AEW25519
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucauaccggcgccaaauccuuuuauaagaaucugaucuggcucguuaaaaagggcaacagcuaccccaaacugucuaaguccuauauuaaugacaaggggaaagaagugcuuguccuguggggaauccaccacccuagcacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccaugacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacgagauuacgaauaaggucaacagcgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagccaaacugaauagagagaagaucgacgggguuaaacuugagagcacgcggaucuaucaaauucuggcuaucuacucuaccguggccuccagccucguccuggugguuucccugggcgcgauuucuuuuuggaugugcagcaacggaucccuccagugccgcaucuguauuuga

SEQ ID NO: 190941 - RNA, 1701 nt, Artificial Sequence
  derived and/or modified sequence opt5 from hemagglutinin__InfluenzaA__AEW25528
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccucuagcuccgacaacggcacgugcuauccgggggauuucauugacuacgaggagcuccgggagcagcugagcucugucuccagcuuugaacgcuucgagaucuuucccaagaccucuuccuggccuaaucacgauagcaacaagggagugacagccgccuguccccaugcuggcgccaaaucuuucuauaagaaucuuaucuggcugguuaaaaagggcaacuccuacccuaaacucagcaaguccuauauuaaugacaaggggaaagaagugcugguccuuuggggaauccaccaccccucuaccagcgcggaucaacagucccuguaccagaacgccgacgcuuacguguuugugggcacaagcagauauucuaagaaauucaagccugagauugccauccggccgaaaguccgcgaucaggagagacggaugaauuacuauuggacccucguugaacccggggacaagauuacguuugaggcuacaggaaaccugguggugccucgcuacgccuucgcgauggaaagaaacgccggcuccgggaucauuaucagcgauacccccguccaugacugcaauacaaccugucaaaccccuaaaggagcuaucaacacaucucugcccuuucagaauauucacccgaucacgauuggcaagugcccuaaguaugugaaaagcaccaagcuccggcuggccacaggccuucgcaacguucccuccauccagucuagagggcuguucggagcuauugccggcuuuaucgaagggggauggaccggcaugguggacgggugguacggauaucaucaccagaaugaacaaggcagcggcuacgccgcugaucucaaauccacacagaacgcgaucgacgagauuaccaauaaggucaacagcgugaucgagaaaaugaauacgcaguucacagccguugggaaggaguucaaccaccuggaaaagcggauugaaaaucuuaacaaaaagguggaugacggauuucuggauaucuggaccuacaaugcugagcuccugguccugcucgaaaacgagcgcacccuggacuaucaugauucuaaugugaaaaaccuuuacgagaaggucagaucccagcugaaaaacaaugccaaggaaauuggcaacggguguuucgaguuuuaucacaagugcgacaauacauguauggaaagcgugaaaaacggaaccuacgauuauccuaaguacucugaggaagccaaacucaaucgggaggagaucgacggcguuaagcuggaauccacacgcaucuaucaaauucuugcuaucuacagcacgguggccuccucucugguccucgugguuagccugggggcgauuuccuucuggaugugcucuaacggcagccugcagugcagaaucuguauuuga

SEQ ID NO: 190942 - RNA, 1701 nt, Artificial Sequence
  derived and/or modified sequence opt5 from hemagglutinin__InfluenzaA__AEW25545
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggaaucugugaagaacggcuccuacgauuaucccaaauacagcgaagaggcuaagcugaauagagaagagaucgacgggguuaaacuugagucuacccggaucuaucaaauucuggccaucuacuccacaguggcgagcucccucgucauggugguuucucugggcgcuauuagcuuuuggaugugcuccaacggaucucugcagugccgcaucuguauuuga

SEQ ID NO: 190943 - RNA, 1701 nt, Artificial Sequence
  derived and/or modified sequence opt5 from hemagglutinin__InfluenzaA__AEW25555
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccauuauugcaauacaaccugucaaacccccaaaggcgccaucaacacaucccucccguuccagaauauucacccuaucacgauuggcaagugccccaaguacgugaaaagcaccaagcugagacuugcuacagggcugcggaacguuccuucuauccagagccgcggacucuuuggcgccauugccggguucaucgagggaggcuggaccgggaugguggacggaugguauggcuaccaucaccagaaugaacaaggcuccggguacgcugcggaccugaaaucuacacagaacgccaucgaugagauuaccaauaaggucaacagcgugaucgagaaaaugaauacgcaguuuacagcuguuggaaaggaguucaaccaccuugagaagagaauugaaaaucugaacaaaaagguggacgauggcuuccucgacaucuggaccuauaaugccgagcugcugguccuccuggaaaacgagcggacccuugauuaccaugacuccaaugugaaaaaccuguaugagaagguccgcagccagcucaaaaacaaugccaaggaaauugggaacggauguuuugaguucuaccacaagugcgauaauacauguauggaaucugugaaaaacggcaccuaugacuaccccaaguauuccgaggaagcuaaacugaauagagaggagaucgaugggguuaaacuugaaagcacacggaucuaccaaauucuggccaucuacucuacgguggcguccagccucguccuggugguuucccugggcgcuauuucuuuuuggaugugcagcaacggaucccuccagugccgcaucuguauuuga

SEQ ID NO: 190944 - RNA, 1701 nt, Artificial Sequence
  derived and/or modified sequence opt5 from hemagglutinin__InfluenzaA__AEW25564
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgcccucaacacaagccugcccuuccagaauauccacccgauuacgaucggcaagugcccuaaguaugugaaaucuaccaaacuuagacuggcuacagggcuccggaacguucccagcauucagucccgcggacuguuuggcgccaucgccggguucauugagggaggcuggaccgggaugguggacggaugguacggcuaucaucaccagaaugaacaaggcucuggguacgcugcggaucuuaagagcacacagaacgccaucgacgagaucaccaauaaggucaacuccgugauugagaaaaugaauacgcaguuuacagcuguuggaaaggaguucaaccaccuggagaagagaaucgaaaaucucaaccggaaaguggaugacggcuuccuggauauuuggaccuacaaugccgagcugcucguccugcuugaaaacgagcgcacccuggacuaucaugauagcaaugugaagaaccucuacgagaaagucagaucucagcugaagaacaaugccaaagaaaucgggaacggauguuuugaguucuaucacaagugcgacaauacauguauggaauccgugaagaacggcaccuacgauuauccuaaauacagcgaggaagcuaaacuuaaucgggaggagauugacgggguuaagcuggaaucuacaggcaucuaucaaauccucgccauuuacuccacgguggcgagcucccugguccuggugguuucucucggagcuaucagcuuuuggaugugcuccaacggcucucugcagugccgcauuuguaucuga

SEQ ID NO: 190945 - RNA, 1701 nt, Artificial Sequence; identical to SEQ ID NO: 186491
  derived and/or modified sequence opt5 from hemagglutinin__InfluenzaA__AEW25573

SEQ ID NO: 190946 - RNA, 1701 nt, Artificial Sequence
  derived and/or modified sequence opt5 from hemagglutinin__InfluenzaA__AEW25582
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauucucuccgauacccccguccaugacugcaauacaaccugucaaaccccuaaaggcgccaucaacacaagccugcccuuccagaauauccacccgauuacgaucggcaagugcccuaaguaugugaaaucuaccaaacuuagacuggcuacagggcuccggaacguucccagcauucagucccgcggacuguuuggcgccaucgccggguucauugagggaggcuggaccgggaugguggacggaugguacggcuaucaucaccagaauggccaagggucuggauacgcugcggaucuuaagagcacacagaacgccaucgacaagaucaccaauaaagucaacuccgugauugaaaagaugaauacgcaguuuacagcuguuggcaaggaguucaaccaccuggagaaaagaaucgaaaaucucaacaagaaaguggaugacggguuccuggauauuuggaccuacaaugccgagcugcucguccugcuugaaaacgagcggacccuggacuaucaugauagcaaugugaagaaccucuacgaaaaaguccgcucucagcugaagaacaaugccaaggagaucggaaacggcuguuuugaguucuaucacaaaugcgacaauacauguauggaauccgugaagaacgggaccuacgauuauccuaaauacagcgaggaagcuaaacuuaauagagaggaaauugacggcguuaagcuggagucuacacggaucuaucaaauccucgccauuuacuccacgguggcgagcucccugguccuggugguuucucucggagcuaucagcuuuuggaugugcuccaacggcucucugcagugccgcauuuguaucuga

SEQ ID NO: 190947 - RNA, 1701 nt, Artificial Sequence
  derived and/or modified sequence opt5 from hemagglutinin__InfluenzaA__AEW25590
augaaggccauccuggugguccuccuguacaccuucgcuacagccaacgcggacacgcuuugcauuggcuaucacgcuaauaacagcaccgauacaguugacaccgugcuggagaagaaugugacagucacccaguccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcaacuuuccagcgucucuuccuucgaacgcuuugagaucuuccccaagaccagcucuuggccuaaucaugauuccaacaagggagugacagccgcuuguccccacgccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucagcagagccucuaccagaacgcugacgccuacguguucgugggcacauccagauauagcaagaaauuuaagccugagauugcuauccggccgaaaguccgcgaucaagaggccagaaugaauuacuauuggacccugguugaacccggggacaagauuacguucgaggcgacaggaaaccugguggugccucgguacgccuuugcuauggaacgcgaugccggcucugggaucauuaucuccgacacccccguccacgacugcaacacaaccugucagaccccuaaaggagcuaucaauacaagccuccccuuccagaacauucauccgaucacgauuggcaagugcccuaaguaugugaaaucuaccaagcugagacuugccacaggccugcggaauguucccagcauccagucccgcgggcucuuuggagccauugcuggcuucaucgaagggggauggaccggcaugguggaugggugguacggauaucaccaucaaaacgaacagggcucuggcuacgcggccgaccugaaaagcacacagaaugcuaucgaugagauuaccaacaaggucaauuccgugaucgagaaaaugaacacgcaguuuacagccguugggaaggaguucaaucaccuugaaaagagaauugaaaaccugaauaaaaagguggacgauggauuccucgacaucuggaccuacaacgccgagcugcugguccuccuggaaaaugagcggacccuugauuaucacgacagcaacgugaaaaaucugcaugagaagguccgcucucaacucaaaaacaacgcuaaggaaauuggcaauggguguuuugaguucuaccacaagugcgauaacacauguauggaauccgugaaaaauggaaccuaugacuacccuaaguauagcgaggaagccaaacugaacagagaggagaucgauggcguuaaacuugaaucuacacggaucuaccagauucuggcgaucuauuccacgguggcuagcucccucguccuggugguuucucugggggccauuagcuuuuggaugugcuccaauggcucucuccagugccgcaucuguauuuga

SEQ ID NO: 190948 - RNA, 1701 nt, Artificial Sequence; identical to SEQ ID NO: 186491
  derived and/or modified sequence opt5 from hemagglutinin__InfluenzaA__AEW25600

SEQ ID NO: 190949 - RNA, 1701 nt, Artificial Sequence; identical to SEQ ID NO: 186491
  derived and/or modified sequence opt5 from hemagglutinin__InfluenzaA__AEW25620

SEQ ID NO: 190950 - RNA, 1701 nt, Artificial Sequence
  derived and/or modified sequence opt5 from hemagglutinin__InfluenzaA__AEW25629
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccgaagcgaaauccuuuuauaagaaucugaucuggcucguuaaaaagggcaacagcuaccccaaacugucuaaguccuauauuaaugacaagggcaaagaggugcuuguccugugggggauccaccacccuagcaccuccgccgaucaacagucucucuaccagaacgcugacgccuacguguucgugggaacaagcagauauuccaagaaauuuaagccggagauugcuauccggcccaaaguccgcgaucaggaaggcagaaugaauuacuauuggacccugguugagccuggggacaagauuacguucgaagccacaggaaaccugguggugccccgguacgcguuugccauggagcgcaacgcuggcagcgggaucauuaucucugauaccccuguccaugacugcaauacaaccugucaaacccccaaaggagccaucaacacaucccucccguuccagaauauucacccuaucacgauuggcaagugccccaaguaugugaaaagcaccaagcugagacuugcuacaggccugcggaacguuccuucuauccagagccgcgggcucuuuggagccauugccggcuucaucgaagggggauggaccggcaugguggacgggugguacggauaucaucaccagaaugagcaaggcuccggcuacgcugcggaucugaaaucuacacagaacgccaucgacgagauuaccaauaaggucaacagcgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauuccaaugugaaaaaccuguacgaaaagguccgcagccagcucaaaaacaaugccaaggagauuggcaacggguguuuugaguucuaucacaagugcgacaauauguguauggagucugugaaaaacggaacauacgauuaucccaaguacuccgaagaggcuaaacugaauagagaggaaaucgacggcguuaaacuugagagcacccggaucuaucaaauucuggccaucuacucuacaguggcguccagccucguccuggugguuucccugggggcuauuucuuuuuggaugugcagcaacggcucccuccagugccgcaucuguauuuga

SEQ ID NO: 190951 - RNA, 1701 nt, Artificial Sequence; identical to SEQ ID NO: 185693
  derived and/or modified sequence opt5 from hemagglutinin__InfluenzaA__AEW25637

SEQ ID NO: 190952 - RNA, 1701 nt, Artificial Sequence
  derived and/or modified sequence opt5 from hemagglutinin__InfluenzaA__AEW25646
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggaaucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190953 - RNA, 1701 nt, Artificial Sequence
  derived and/or modified sequence opt5 from hemagglutinin__InfluenzaA__AEW25654
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaucucccccguuccagaauauucacccuaucacgauuggcaagugccccaaguaugugaaaagcaccaagcucagacuggcuacagggcuucggaacaucccuagcauucagucccgcggacuguuuggcgccaucgccggguucaucgagggaggcuggaccgggaugguugacggaugguacggcuaucaucaccagaaugaacaaggcucuggguacgcugcggaucucaaaagcacacagaacgccauugacgagaucaccaauaaggugaacuccgucauugagaaaaugaauacgcaguuuacagcugugggaaaggaguucaaccaccuggagaagagaaucgaaaaucuuaacaaaaagguugaugacggcuuccuggauauuuggaccuacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccgucaaaaacggcaccuacgauuaucccaaguacagcgaggaagcuaaacucaauagagaggagaucgacggggugaagcuggaaucuacacggauuuaucaaauccuugccauuuacuccacgguugcgagcucccuggugcucgucgugucucugggcgcuaucagcuuuuggaugugcuccaacggaucucugcagugccgcauuuguaucuga

SEQ ID NO: 190954 - RNA, 1701 nt, Artificial Sequence
  derived and/or modified sequence opt5 from hemagglutinin__InfluenzaA__AEW25662
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggaaucacagccgcuuguccucaugccggcgcgaaauccuuuuauaagaaucugauuuggcucgugaaaaagggcaacagcuaccccaaacugucuaaguccuauaucaaugacaaggggaaagaaguucuugugcuguggggcauucaccacccuagcaccuccgccgaucaacagucucucuaccagaacgcugacgccuacgucuucgugggaacaagcagauauuccaagaaauuuaagccggagaucgcuauucggcccaaagugcgcgaucaggaggggagaaugaauuacuauuggacccuggucgaaccuggagacaagaucacguucgaggccacaggcaaccugguugugccccgguacgcguuugccauggaacgcaacgcugggagcggaauuaucaucucugauaccccugugcaugacugcaauacaaccugucaaacccccaaaggcgccauuaacacaucccucccguuccagaauauccacccuauuacgaucggcaagugccccaaguaugucaaaagcaccaagcugagacuugcuacagggcugcggaacgugccuucuauucagagccgcggacucuuuggcgccaucgccggguucaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuuugaguucuaucacaagugcgacaauacauguauggaaucugucaaaaacggcaccuacgauuaucccaaguacuccgaggaagcuaaacugaauagagaggagaucgacggggugaaacuugaaagcacacggauuuaucaaauccuggccauuuacucuacgguugcguccagccucgugcuggucgugucccugggcgcuaucucuuuuuggaugugcagcaacggaucccuccagugccgcauuuguaucuga

SEQ ID NO: 190955 - RNA, 1701 nt, Artificial Sequence
  derived and/or modified sequence opt5 from hemagglutinin__InfluenzaA__AEW25669
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggaaggaugguacggcuaucaucaccagaaugagcaaggcuccggguacgcugcggaccugaaaucuacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacuccaaugugaaaaaccuguacgaaaagguccgcagccagcucaaaaacaaugccaaggagauugggaacggauguuuugaguucuaucacaagugcgauaauacauguauggagucugugaaaaacggcaccuacgacuaucccaaguacuccgaagaggcuaaacugaauagagaggaaaucgaugggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190956 - RNA, 1701 nt, Artificial Sequence
  derived and/or modified sequence opt5 from hemagglutinin__InfluenzaA__AEW25678
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugcgggcuauuagcuuuuggaugugcuccaacggcucucuccagugccgcaucuguauuuga

SEQ ID NO: 190957 - RNA, 1701 nt, Artificial Sequence
  derived and/or modified sequence opt5 from hemagglutinin__InfluenzaA__AEW25687
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccuuaugccggcgcgaaauccuuuuacaagaaucugaucuggcucguuaaaaagggcaacagcuaucccaaacugucuaaguccuacauuaaugacaaggggaaagaagugcuuguccuguggggaauccaucacccuagcaccuccgccgaucaacagucucucuaccagaacgcugacgccuauguguucgugggcacaagcagauacuccaagaaauuuaagccggagauugcuauccggcccaaaguccgcgaucaggaggggagaaugaauuauuacuggacccugguugaaccuggagacaagauuacguucgaggccacaggcaaccugguggugccccgguaugcguuugccauggaacgcaacgcugggagcggaaucauuaucucugauaccccuguccacgacugcaauacaaccugucaaacccccaaaggcgccaucaacacaucccucccguuccagaauauucauccuaucacgauuggcaagugccccaaguacgugaaaagcaccaagcugagacuugcuacagggcugcggaacguuccuucuauccagagccgcggacucuuuggcgccauugccggguucaucgagggaggcuggaccgggaugguggacggaugguauggcuaccaccaucagaaugaacaaggcuccggguacgcugcggaucugaaaucuacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuauaaugccgaacugcugguccuccuggagaacgaacggacccuugacuaccacgauuccaaugugaagaaccuguaugagaaaguccgcagccagcucaagaacaaugccaaggagauugggaacggauguuuugaguucuaccauaaaugcgacaauacauguauggaaucugugaagaacggcaccuaugauuaccccaaauauuccgaagaggcuaagcugaauagagaagagaucgacgggguuaaacuugagagcacacggaucuaccaaauucuggccaucuacucuacgguggcguccagccucguccuggugguuucccugggcgcuauuucuuuuuggaugugcagcaacggaucccuccagugccgcaucuguauuuga

SEQ ID NO: 190958 - RNA, 1701 nt, Artificial Sequence; identical to SEQ ID NO: 190927
  derived and/or modified sequence opt5 from hemagglutinin__InfluenzaA__AEW25696

SEQ ID NO: 190959 - RNA, 1701 nt, Artificial Sequence; identical to SEQ ID NO: 186491
  derived and/or modified sequence opt5 from hemagglutinin__InfluenzaA__AEW25706

SEQ ID NO: 190960 - RNA, 1695 nt, Artificial Sequence
  derived and/or modified sequence opt5 from hemagglutinin__InfluenzaA__AEW91908
auggagaagaucgugcuccuguucgccaccauuagccuggucaaauccgaccacaucugcauuggcuaccaugcuaacaauucuacagaacagguugauacgaucauggagaagaacgugaccgugacacacgcccaagacauucuugaaaagacccauaaugggaagcugugugaucucaacggagucaaaccccugauccuuaaggacugcagcguggcgggcuggcugcucgggaauccuaugugugaugaguuuaucaacguuccggaaugguccuauauuguggagaaggcuaaucccgccaacgaccugugcuacccuggaaauuucaacgauuaugaggaacugaaacaccuccugucuagaaucaaucauuuugagaagauucagaucauucccaaaaacagcugguccgaccacgaagccucucuuggcgucagcgcugccuguccuuaccaggggaaguccagcuucuuucggaaugugguuuggcugaucaaaaaggauaacgcuuaucccacaauuaagaaaggauacaauaacaccaaccaggaggaccuccuggugcuuuggggcauccaccauccuaaugaugaggccgaacaaacacgccuguaucagaacccgaccacguacaucucuauuggcaccuccacacucaaucagagacugguccccaagaucgcgacccggagcaaaauuaacgggcagucuggacgcaucgacuucuuuuggacaauucugaagccuaaugaugccauccacuucgaguccaacggcaauuuuaucgcucccgaauacgccuauaaaauugugaagaaaggggacagcaccaucaugaagucugagguggaauacggaaacugcaauacgagaugucaaacaccuauuggcgcuaucaacuccagcaugcccuuccauaauauucacccgcucaccaucggggagugcccuaaguaugucaaauccaacaagcugguucuugccacaggacugcgcaauucuccccagggcgagacccggggccucuuuggggcgaucgccggauucauugaaggcggguggcagggaaugguggacggcugguacggguaucaccauagcaacgagcagggauccggcuacgcugccgauaaagaaagcacccaaaaggcuaucgacggcgugacaaauaaagucaacucuauuaucgauaagaugaacacgcaguuugaggccguggggagagaguucaauaaccuggaacggcgcauugagaaucuuaacaagaaaauggaagacggauuccuggauguuuggaccuauaaugccgagcuccuggugcugauggaaaacgagagaacacucgacuuucacgauuccaauguccggaaccuguacgacaaggugcgccuucagcugaaagauaaugcuaaggaacucggcaacggguguuucgaguuuuaccauaaaugcgacaaugaguguauggaaagcguuagaaacggaaccuaugauuacccucaauauucugaggaagcgcggcugaagcgcgaggagaucagcggcgugaaacuugaauccauugggaucuaccagauccugucuauuuauagcacagucgccuccagccucgugcuggcuaucaugauggccggccugucucucuggaugugcuccaauggaagccugcagugcagaauuuguaucuga

SEQ ID NO: 190961 - RNA, 1701 nt, Artificial Sequence
  derived and/or modified sequence opt5 from hemagglutinin__InfluenzaA__AEX09175
augaaggccauccuggugguccuccuguacaccuucgcuacagccaacgcggacacgcuuugcauuggcuaucacgcuaauaacagcaccgauacaguugacaccgugcuggagaaaaauguggccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgauagagaggggcggaugaauuacuauuggacacugguugaacccggagacaagauuaccuucgaggcgacgggcaaccugguggugccucgcuacgccuuugcuauggaaagaaacgccgggucuggaaucauuaucuccgauacacccguccaugacugcaauaccacaugucagaccccuaaaggcgcuaucaacaccagccuccccuuccaaaauauucacccgaucacaauuggcaagugcccuaaguaugugaaaucuacgaagcugcggcuugccaccgggcugcgcaacguucccagcauccaguccagaggacucuuuggcgccauugcuggguucaucgagggaggcuggacagggaugguggacggaugguacggcuaucaucaccagaaugaacagggcucuggguacgcggccgaucugaaaagcacccaaaacgcuaucgacgagauuacaaauaaggucaacuccgugaucgagaaaaugaauacccaguuuacggccguuggaaaggaguucaaccaccuugagaagcggauugaaaaucugaacaaaaagguggaugacggcuuccucgauaucuggacauacaaugccgagcugcugguccuccuggaaaacgagcgcacccuugacuaucaugauagcaaugugaaaaaccuguacgagaaggucagaucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaaucgggaggagaucgacgggguuaaacuugaaucuacccgcaucuaucagauucuggcgaucuacuccacaguggcuagcucccucguccuggugguuucucugggcgccauuagcuuuuggaugugcuccaacggaucucuccaaugcagaaucuguauuuga

SEQ ID NO: 190962 - RNA, 1701 nt, Artificial Sequence; identical to SEQ ID NO: 185693
  derived and/or modified sequence opt5 from hemagglutinin__InfluenzaA__AEX25795

SEQ ID NO: 190963 - RNA, 1701 nt, Artificial Sequence
  derived and/or modified sequence opt5 from hemagglutinin__InfluenzaA__AEX25797
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcuccccuccaucugggcaagugcaacaucgccggguggauucugggaaauccugaaugugagucucucagcacagccuccucuuggagcuacaucguggaaaccuccaacucugacaauggcacgugcuauccgggggauuuuauugacuacgaggagcugcgggaacagcuuagcuccgucagcucuuucgagcgcuuugaaaucuuccccaaaaccuccagcuggccuaaccacgauucuaauaagggagugacagccgcuuguccccaugccggcgcgaaguccuuuuauaaaaaccugaucuggcucguuaagaaaggcaauagcuacccuaagcugucuaaauccuauauuaacgacaaggggaaggaggugcuuguccuguggggaauccaccaccccagcaccuccgccgaucaacagucucucuaccagaaugcugacgccuacguguucgugggcagcuccagauauagcaaaaaguuuaaaccugagauugcuauccggccgaagguccgcgaucaggaagggagaaugaacuacuauuggacacugguugagcccggagacaaaauuaccuucgaagccacgggcaaccugguggugccucgguacgcguuugccauggagcgcaaugcugggucuggaaucauuaucuccgauacacccguccaugacugcaacaccacaugucaaaccccuaagggcgccaucaauaccagccuccccuuccacaacauucauccgaucacaauuggcaaaugcccuaaguaugugaagucuacgaaacugagacuugcuaccgggcugcggaauguucccagcauccagucccgcggacucuuuggcgccauugccggguucaucgaaggaggcuggacagggaugguggacggaugguacggcuaucaccaccagaacgagcagggcucuggguacgcugcggaucuuaagagcacccaaaaugccaucgacgagauuacaaacaaagucaauuccgugaucgaaaagaugaacacccaguuuacggcuguuggaaaagaguucaaucaucuugaaaagagaauugagaaccugaauaagaaaguggaugacggcuuccucgauaucuggacauacaacgccgaacugcugguccuccuggagaaugagcggacccuugacuaucacgauagcaacgugaagaaccuguacgaaaaaguccgcucucagcucaagaauaacgccaaagagauugggaauggauguuuugaguucuaucauaagugcgacaacaccuguauggaauccgugaagaauggcacauacgauuauccuaaauacagcgaagaggcuaagcugaacagagaggaaaucgacgggguuaaacuugagucuacccggaucuaucagauucuggccaucuacuccacaguggcgagcucccucguccuggugguuucucugggcgcuauuagcuuuuggaugugcuccaauggaucucuccaaugccgcaucuguauuuga

SEQ ID NO: 190964 - RNA, 1701 nt, Artificial Sequence
  derived and/or modified sequence opt5 from hemagglutinin__InfluenzaA__AEX25798
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccacaacauucauccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaccaccagaacgaacagggcucuggguacgcugcggaccugaaaagcacacaaaaugccaucgaugagauuaccaacaaggucaauuccgugaucgagaaaaugaacacgcaguuuacagcuguuggaaaggaguucaaucaucuugagaagagaauugaaaaccugaauaaaaagguggacgauggcuuccucgacaucuggaccuacaacgccgagcugcugguccuccuggaaaaugagcggacccuugauuaucacgacagcaacgugaaaaaccuguacgagaagguccgcucucagcucaaaaauaacgccaaggaaauugggaauggauguuuugaguucuaucauaagugcgauaacacauguauggaauccgugaaaaauggcaccuacgacuauccuaaguacagcgaggaagcuaaacugaacagagaggagaucgaugggguuaaacuugaaucuacacggaucuaucagauucuggccaucuacuccacgguggcgagcucccucguccuggugguuucucugggcgcuauuagcuuuuggaugugcuccaauggaucucuccaaugccgcaucuguauuuga

SEQ ID NO: 190965 - RNA, 1701 nt, Artificial Sequence; identical to SEQ ID NO: 185693
  derived and/or modified sequence opt5 from hemagglutinin__InfluenzaA__AEX25800

SEQ ID NO: 190966 - RNA, 1701 nt, Artificial Sequence; identical to SEQ ID NO: 185693
  derived and/or modified sequence opt5 from hemagglutinin__InfluenzaA__AEX25803

SEQ ID NO: 190967 - RNA, 1701 nt, Artificial Sequence; identical to SEQ ID NO: 185935
  derived and/or modified sequence opt5 from hemagglutinin__InfluenzaA__AEX25808

SEQ ID NO: 190968 - RNA, 1701 nt, Artificial Sequence; identical to SEQ ID NO: 188663
  derived and/or modified sequence opt5 from hemagglutinin__InfluenzaA__AEX25810

SEQ ID NO: 190969 - RNA, 1701 nt, Artificial Sequence
  derived and/or modified sequence opt5 from hemagglutinin__InfluenzaA__AEX25811
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaaacugagaggaguugcuccccuccaucugggcaagugcaacaucgccggguggauucugggaaauccugaaugugagucucucuuuacagccagcuccuggucuuacaucguggaaaccagcuccucugacaacggcacgugcuauccgggggauuucauugacuacgaggagcugcgggaacagcuuagcuccgucagcucuuuugagcgcuucgaaaucuuucccaaaaccuccagcuggccuaaucacgauucuaacaagggagugacagccgcuuguccccaugccggcgcgaaguccuucuauaaaaaucugaucuggcucguuaagaaaggcaacagcuacccuaagcugucuaaauccuauauuaaugacaaggggaaggaggugcuuguccuguggggaauccaccaccccagcaccuccgccgaucaacagucucucuaccagaacgcugacgccuacguguuugugggcagcuccagauauagcaaaaaguucaaaccugagauugcuauccggccgaagguccgcgaucaggaagggagaaugaauuacuauuggacacugguugagcccggagacaaaauuaccuuugaagccacgggcaaccugguggugccucgguacgcguucgccauggagcgcaaggcugggucuggaaucauuaucuccgauacacccguccaugacugcaacaccacaugucaaaccccuaaaggcgccaucaauaccagccuccccuuucacaacauucauccgaucacaauuggcaagugcccuaaguaugugaaaucuacgaagcugagacuugcuaccgggcugcggaauguucccagcauccagucccgcggacucuucggcgccauugccggguuuaucgaaggaggcuggacagggaugguggacggaugguacggcuaucaccaccagaacgagcagggcucuggguacgcugcggaucugaaaagcacccaaaaugccaucgacgagauuacaaacaaggucaauuccgugaucgaaaagaugaacacccaguucacggcuguuggaaaggaguucaaucaucuugaaaagagaauugagaaccugaauaaaaagguggaugacggcuuucucgauaucuggacauacaacgccgaacugcugguccuccuggagaaugagcggacccuugacuaucacgauagcaacgugaaaaaucuguacgaaaagguccgcucucagcucaaaaacaacgccaaggagauugggaauggauguuucgaauuuuaucauaagugcgacaacaccuguauggaguccgugaaaaauggcacauacgauuauccuaaguacagcgaagaggcuaaacugaacagagaggaaaucgacgggguuaaacuugagucuacccggaucuaucagauucuggccaucuacuccacaguggcgagcucccucguccuggugguuucucugggcgcuauuagcuucuggaugugcuccaauggaucucuccaaugccgcaucuguauuuga

SEQ ID NO: 190970 - RNA, 1701 nt, Artificial Sequence; identical to SEQ ID NO: 188663
  derived and/or modified sequence opt5 from hemagglutinin__InfluenzaA__AEX25814

SEQ ID NO: 190971 - RNA, 1701 nt, Artificial Sequence
  derived and/or modified sequence opt5 from hemagglutinin__InfluenzaA__AEX25816
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauuaacuacgaagaacugcgggagcagcuuagcuccgucagcucuuucgaacgcuuugagaucuuccccaagaccuccagcuggccuaaucacgacucuaacaagggagugacagccgcuuguccccaugccggcgcgaaauccuuuuauaagaaucugaucuggcucguuaaaaagggcaacagcuacccuaaacugucuaaguccuauauuaaugauaaggggaaagaagugcuuguccuguggggaauccaccaccccagcaccuccgccgaccaacagucucucuaccagaacgcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggagcggaaucauuaucucugacacccccguccaugauugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgagggaggcuggaccgggaugguggacggaugguacggcuaucaucaccagaaugaacaaggcuccggguacgcugcggaccugaaaucuacacagaacgccaucgaugagauuaccaauaaggucaacagcgugaucgagaaaaugaauacgcaguuuacagcuguuggaaaggaguucaaccaccuugagaagagaauugaaaaucugaacaaaaagguggacgauggcuuccucgacaucuggaccuacaaugccgagcugcugguccuccuggaaaacgagcggacccuugauuaucaugacuccaacgugaaaaaucuguacgagaagguccgcagccagcucaaaaacaaugccaaggaaauugggaacggauguuuugaguucuaucacaagugcgauaauacauguauggaaucugugaaaaacggcaccuacgacuauccuaaguacuccgaggaagcuaaacugaauagagaggagaucgaugggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 190972 - RNA, 1701 nt, Artificial Sequence
  derived and/or modified sequence opt5 from hemagglutinin__InfluenzaA__AEX25818
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcuccccuccaucugggcaagugcaacaucgccggguggauucugggaaauccugaaugugagucucucagcacagccuccucuuggagcuacaucguggaaaccuccaacucugacaauggcacgugcuauccgggggauuuuauugacuacgaggagcugcgggaacagcuuagcuccgucagcucuuucgagcgcuuugaaaucuuccccaaaaccuccagcuggccuaaccacgauucuaauaagggagugacagccgcuuguccccaugccggcgcgaaguccuuuuauaaaaaccugaucuggcucguuaagaaaggcaauagcuacccuaagcugucuaaauccuauauuaacgacaaggggaaggaggugcuuguccuguggggaauccaccaccaaagcaccuccgccgaucagcagucucucuaccagaaugcugacgccuacguguucgugggcagcuccagauauagcaaaaaguuuaaacccgagauugcuauccggccuaagguccgcgaucaagaagggagaaugaacuacuauuggacacugguugagccgggagacaaaauuaccuucgaagccacgggcaaccugguggugccccgguacgcguuugccauggagcgcaaugcugggucuggaaucauuaucuccgauacaccuguccaugacugcaacaccacaugucagacccccaagggcgccaucaauaccagccucccuuuccacaacauucaucccaucacaauuggcaaaugcccgaaguaugugaagucuacgaaacugagacuugcuaccgggcugcggaauguuccuagcauccagucccgcggacucuuuggcgccauugccggguucaucgaaggaggcuggacagggaugguggacggaugguacggcuaucaccaccagaacgagcaaggcucuggguacgcugcggaucuuaagagcacccagaaugccaucgacgagauuacaaacaaagucaauuccgugaucgaaaagaugaacacccaguuuacggcuguuggaaaagaguucaaucaucuugaaaagagaauugagaaccugaauaagaaaguggaugacggcuuccucgauaucuggacauacaacgccgaacugcugguccuccuggagaaugagcggacccuugacuaucacgauagcaacgugaagaaccuguacgaaaaaguccgcucucagcucaagaauaacgccaaagagauugggaauggauguuuugaguucuaucauaagugcgacaacaccuguauggaauccgugaagaauggcacauacgauuaucccaaauacagcgaagaggcuaagcugaacagagaggaaaucgacgggguuaaacuugagucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 190973 - RNA, 1701 nt, Artificial Sequence
  derived and/or modified sequence opt5 from hemagglutinin__InfluenzaA__AEX25824
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguauguggagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 190974 - RNA, 1698 nt, Artificial Sequence
  derived and/or modified sequence opt5 from hemagglutinin__InfluenzaA__AEX33420
augaaggugaaacugcucguccugcuuugcaucuucaccgccacauacgcugacacgauuuguaucggcuaucacgccaacaauagcaccgauacaguugacaccgugcuggagaagaacgugacagucacccauuccgugaaucuccuggaagauucucacaacgggaaacuuugccugcucaagggaauugcgccccugcagcugggcaauuguagcguugcuggguggauccucggaaacccugagugcgaacugcuuauuuccaaagagucuuggagcuacaucguggaaacaccgaaucccgagaacggcaccuguuauccuggguacuuugccgacuaugaggaacugagagagcaacucuccucugucagcuccuucgaacgguuugagaucuuccccaaggagagcucuuggccuaaucauacggugaccggaguuuccgccagcugcucucacaacggcaaguccagcuuuuaccgcaaucugcuuuggcugacaggcaaaucugggcucuaucccaaccuguccaagagcuacgcuaauaacaaagaaaaggaggugcugguccucuggggagugcaucacccuccgaauauuggcgaucagagagcccuguaccacaccgaaaacgcuuauguguccgucguuucuagccauuacucccggcgcuucacacccgagaucgccaaaagaccuaaggugcgggaccaggaagggcgcauuaacuauuacuggacccuucuggagcccggagauacgaucauuuuugaggcgaauggcaaccucaucgccccuagauaugcuuucgcccugagccggggguuuggaucuggcauuaucacauccaaugcucccauggacgaaugugaugccaagugccagaccccgcaaggcgcgaucaacagcucucuuccuuuccagaaugugcaccccgucacaauuggggaguguccuaaauacguuaagagcgccaaacugcgcauggugaccggacucagaaacauccccuccauucagucucggggccuguuuggggcuaucgccggauucauugaaggcggguggaccggaaugguggacggcugguauggcuaccaucaccagaaugagcaagggagcggauacgcugccgaucagaaguccacacagaacgccaucaauggcaucacgaacaaagucaauagcgugauugaaaagaugaacacccaguuuacagcuguugggaaagaguucaauaagcuggagcgcagaauggaaaaccucaauaagaaaguggacgauggauuccuggacaucuggaccuauaacgcggagcuucugguccuccuggaaaacgagcggacacuugacuuucacgauucuaaugugaagaaccuguacgaaaaagucaagucccaacucaaaaauaacgccaaggagauuggcaaugggugcuucgaguuuuaucauaaguguaacgacgaaugcauggagagcgugaaaaauggcaccuacgauuaucccaaguacucugaagaguccaaacugaaccgcgagaagaucgacggaguuaaacuggaaagcaugggcguguaucagauucucgcuaucuacuccacggucgccucuagccuggugcuucugguuucccucggggccaucucuuucuggaugugcagcaauggaucccugcaguguagaauuugcaucuga

SEQ ID NO: 190975 - RNA, 1701 nt, Artificial Sequence
  derived and/or modified sequence opt5 from hemagglutinin__InfluenzaA__AEX33453
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucugacaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaagacuggauucuguggaucagcuuugccauuuccugcuuccuucuguguguggcccuccugggguuuaucaugugggcuugccagaagggaaauauuagauguaacaucugcaucuga

SEQ ID NO: 190976 - RNA, 1701 nt, Artificial Sequence; identical to SEQ ID NO: 184819
  derived and/or modified sequence opt5 from hemagglutinin__InfluenzaA__AEX33464

SEQ ID NO: 190977 - RNA, 1701 nt, Artificial Sequence; identical to SEQ ID NO: 184819
  derived and/or modified sequence opt5 from hemagglutinin__InfluenzaA__AEX33475

SEQ ID NO: 190978 - RNA, 1701 nt, Artificial Sequence; identical to SEQ ID NO: 184819
  derived and/or modified sequence opt5 from hemagglutinin__InfluenzaA__AEX33486

SEQ ID NO: 190979 - RNA, 1701 nt, Artificial Sequence; identical to SEQ ID NO: 184819
  derived and/or modified sequence opt5 from hemagglutinin__InfluenzaA__AEX33497

SEQ ID NO: 190980 - RNA, 1701 nt, Artificial Sequence; identical to SEQ ID NO: 184819
  derived and/or modified sequence opt5 from hemagglutinin__InfluenzaA__AEX33508

SEQ ID NO: 190981 - RNA, 1701 nt, Artificial Sequence; identical to SEQ ID NO: 184819
  derived and/or modified sequence opt5 from hemagglutinin__InfluenzaA__AEX33519

SEQ ID NO: 190982 - RNA, 1701 nt, Artificial Sequence
  derived and/or modified sequence opt5 from hemagglutinin__InfluenzaA__AEX33541
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugagagcuucgacuggaccggcgugacacagaacggcaccucuuccagcugcaagcgcagaucuaauaaguccuuuuucagccggcugaacuggcucacacaucugaaauauaaguacccugcucuuaaugucaccaugcccaacaaugaaaaauuugauaagcuguauauuuggggagugcaccauccugggacggacucugaucagaucucccucuacgcccaggcgagcggccgcauuacaguuuccaccaaaagaucucaacagacagugaucccgaacauugggagccggccccgcgucagagacguguccagccggaucucuaucuacuggaccauugugaagccuggagacauccugcugauuaacuccaccggcaaucucaucgcuccccgcggguauuucaagauuagaagcggaaaaucuagcaucaugcgguccgaugccccuaucggcaaguguaacucugagugcauuacacccaauggcagcaucccgaacgacaaaccuuuucagaaugucaaccgcauuacguacggggccugucccagauauguuaagcagaauacccugaaacuugcuacaggaaugcggaacgugccugaaaagcaaacccgcggcaucuucggggccauugcgggauuuaucgagaauggcugggaagggaugguggauggaugguacggcuucagacaccagaacuccgagggcacagggcaggccgcugaccugaaaagcacccaagccgcuaucaaucagauuaacggaaagcucaaucggcugaucggcaagacgaacgagaaauuucaccagauugaaaaggaguucucugaagucgaggggagaauccaggaucuugaaaaauauguggaggacacaaagauugaucugugguccuacaaugccgagcuccugguugcccuggaaaaccaacauaccaucgaccucaccgauagcgagaugaacaaacuguucgaacgcacaaagaagcagcuucgggagaaugcugaagacaugggaaacggcugcuuuaaaauuuaucacaagugugauaaugcgugcaucgggucuaucagaaacggcaccuacgaccaugacguguaccgcgaugaggcccugaauaaccgguuccagauuaaaggagucgagcucaaguccggcuauaaagacuggauccuguggauuagcuuugcuaucuccugcuuccuucuguguguggcccuccugggguuuauuaugugggccugccagaagggaaauaucagauguaacaucugcauuuga

SEQ ID NO: 190983 - RNA, 1701 nt, Artificial Sequence
  derived and/or modified sequence opt5 from hemagglutinin__InfluenzaA__AEX33574
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuaagcagaauacccugaaacuugccacaggaaugcggaacgugcccgaaaagcaaacccgcggcauuuuuggggcgaucgccggauucauugagaauggcugggaagggaugguggacggaugguauggcuuuagacaccagaacucugagggcacagggcaggcugccgaucugaaaagcacccaagcugccaucaaucagaucaacggaaagcucaaucggcugauuggcaagacgaacgagaaauuccaccagaucgaaaaggaguucuccgaagucgaggggcgcauucaggaccuugaaaaauacguggaggauacaaagaucgaccuguggagcuauaacgccgagcuccugguugcucuggaaaaucaacauaccauugaucucaccgacucugagaugaacaaacuguuugaaagaacaaagaagcagcuucgggagaaugcggaagauaugggaaacggcugcuucaaaaucuaccacaagugugacaaugauugcauuggguccaucagaaacggcaccuaugaccaugacguguaccgcgaugaggcccugaauaaccgguuucagaucaaaggagucgagcucaagagcggcuacaaagacuggauucuguggaucucuuucgcuauuuccugcuuucuucuguguguggcccuccugggguucaucaugugggccugccagaagggaaauauuagauguaacaucugcaucuga

SEQ ID NO: 190984 - RNA, 1701 nt, Artificial Sequence; identical to SEQ ID NO: 184819
  derived and/or modified sequence opt5 from hemagglutinin__InfluenzaA__AEX33585

SEQ ID NO: 190985 - RNA, 1701 nt, Artificial Sequence
  derived and/or modified sequence opt5 from hemagglutinin__InfluenzaA__AEX33596
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagauauuccuagccggaucuccaucuacuggaccauugugaagcccggagacauccugcugauuaacagcaccggcaaucucaucgcuccucgcggguacuuuaagauuagaucuggaaaauccagcaucaugcggucugacgcccccaucggcaaguguaacagcgagugcauuacaccgaauggcuccaucccuaacgauaaacccuuccagaaugugaaccgcauuacguauggggcuuguccuagauacgucaagcagaauacccugaaacuugccacaggaaugcggaacguucccgaaaagcaaacccgcggcaucuuuggggcgauugccggauucaucgagaauggcugggaagggaugguggacggaugguauggcuuuagacaccagaacucugagggcacagggcaggcugccgaucugaaaagcacccaagcugccaucaaucagauuaacggaaagcucaaucggcugaucggcaagacgaacgagaaauuccaccagauugaaaaggaguucuccgaaguggaggggagaauccaggaccuugaaaaauacgucgaggauacaaagauugaccuguggagcuauaacgccgagcuccugguggcucuggaaaaucaacauaccaucgaucucaccgacucugagaugaacaaacuguuugaacgcacaaagaagcagcuucgggagaaugcggaagauaugggaaacggcugcuucaaaauuuaccacaagugugacaaugccugcaucggguccaucagaaacggcaccuaugaucaugacguuuaccgcgacgaggcucugaauaaccgguuucagauuaaaggaguggagcucaagagcggcuacaaagauuggauccuguggauuucuuucgccaucuccugcuuucuucugugugucgcccuccugggguucauuaugugggcuugccagaagggaaauaucagauguaacaucugcauuuga

SEQ ID NO: 190986 - RNA, 1701 nt, Artificial Sequence; identical to SEQ ID NO: 184819
  derived and/or modified sequence opt5 from hemagglutinin__InfluenzaA__AEX33618

SEQ ID NO: 190987 - RNA, 1701 nt, Artificial Sequence; identical to SEQ ID NO: 184819
  derived and/or modified sequence opt5 from hemagglutinin__InfluenzaA__AEX33629

SEQ ID NO: 190988 - RNA, 1701 nt, Artificial Sequence; identical to SEQ ID NO: 190985
  derived and/or modified sequence opt5 from hemagglutinin__InfluenzaA__AEX33640

SEQ ID NO: 190989 - RNA, 1701 nt, Artificial Sequence
  derived and/or modified sequence opt5 from hemagglutinin__InfluenzaA__AEX33836
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauaucuuccugauuaacuccaccggcaaucugaucgcuccucgcggguacuuuaagauuagaagcggaaagucuuccaucaugcggagcgacgcccccaucggcaaauguaacucugagugcauuacaccgaauggcagcaucccuaacgacaagcccuuccagaaugugaaccgcauuacguauggggcuuguccuagauacgucaaacagaauacccucaagcuggccacaggaaugcggaacguucccgaaaaacaaacccgcggcaucuuuggggcgauugccggauucaucgagaauggcugggaagggaugguggauggaugguauggcuucagacaccagaacuccgagggcaucgggcaggcugccgaccuuaagucuacacaagcugccauuaaucagaucaacggaaaacugaaccggcucauuggcaagaccaaugagaaguuucaccagaucgaaaaagaguucagcgaaguggaggggcgcauucaggaucuggaaaaguacgucgaggacacgaaaaucgaucuuugguccuauaacgccgagcugcucguggcucuggaaaaucaacauacaauugaccugaccgauagcgagaugaacaagcucuuugaaagaaccaaaaagcagcugcgggagaaugcggaagacaugggaaacggcugcuucaagaucuaccacaaaugugauaaugccugcaucgggucuauuagaaacggcacauaugaccaugauguuuaccgcgacgaggcucuuaauaaccgguuucagaucaagggaguggagcugaaauccggcuacaaggacuggauucucuggaucagcuucgccauuucuugcuuucugcuuugugucgcccugcucggguucaucaugugggcuugccagaaaggaaauaucagauguaacauuugcaucuga

SEQ ID NO: 190990 - RNA, 1701 nt, Artificial Sequence; identical to SEQ ID NO: 183654
  derived and/or modified sequence opt5 from hemagglutinin__InfluenzaA__AEX33880

SEQ ID NO: 190991 - RNA, 1698 nt, Artificial Sequence
  derived and/or modified sequence opt5 from hemagglutinin__InfluenzaA__AEX33913
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagaauagcuggccuaaccacacgaccacaggagugucugccuccugcagccauaauggcgaaucuuccuuuuauaagaaccugcuuuggcugaccggcaaaaaugggcucuaccccaaccugagcaagucuuaugcuaauaacaaaaagaaagagguucuggugcucuggggaguccaccacccuccgaacaucggcaaucagagagcccuguaccauacagaaaacgcuuacguguccguggucagcucccacuauucucggaaguucacccccgagauugccaagcgcccuaaaguuagagaucaggaagggcggaucaauuacuauuggacgcuucuggagcccggagacacaauuaucuuugaggcgaacggcaaucucauugccccucgcuacgcuuucgcccugagcagaggguuuggauccggcaucauuaacagcaaugcucccauggaugaaugugacgccaagugccagaccccgcaaggcgcgaucaacucuucccuuccuuuccagaaugugcaucccgugacaaucggggaguguccuaaauauguccggagcgccaagcugcgcauggugaccggacucagaaacauucccucuauccagagccggggccuguuuggggcuauugccggauucaucgaaggcggguggaccggaaugguugauggcugguacggcuaucaccaccagaaugagcaaggguccggauacgcugccgaccagaaaucuacacagaacgccauuaauggcaucacgaacaaggugaauagcgucaucgaaaagaugaacacccaguuuacagcuguggggaaagaguucaacaagcuggagcgcagaauggaaaaucucaacaaaaagguugaugacggauucauugauaucuggaccuacaaugcggagcugcuugugcugcucgaaaacgagcggacacuggacuuucaugacuccaaugucaaaaaccuuuaugaaaaggugaaaagccaacugaagaauaacgccaaggagauuggcaaugggugcuucgaguuuuaccacaaauguaacgaugaaugcauggagucugucaagaauggcaccuaugacuaccccaaauauuccgaagagagcaagcucaaccgcgagaaaaucgauggagugaaguucgaaucuaugggcguuuaccagauucuggcuaucuauuccacgguggccagcucccugguccuccuggugucucuuggggccaucagcuuuuggaugugcuccaauggaucucugcaguguagaauuugcaucuga

SEQ ID NO: 190992 - RNA, 1698 nt, Artificial Sequence
  derived and/or modified sequence opt5 from hemagglutinin__InfluenzaA__AEX33924
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuagagagagcugguccuacauuguggaaaaaccgucucccgagaauggcaccuguuauccugggcauuuugccgacuacgaggaacuucgggagcaacugagcuccgucagcucuuucgaacgcuuugagaucuuccccaaggaguccagcuggccuaaccacacggccaccggagugucugcuuccugcagccauaauggcaagucuuccuuuuauaaaaaccuccuguggcuuacaggcaagaaugggcuguaccccaaccucagcaaauccuaugccaauaacaaggaaaaagagguucuggugcuguggggaguccaccacccuccgaauaucggcgaucagagagcucucuaccauaccgaaaacgccuacgugucuguggucagcucccacuauagccggaaguucacacccgagauugcgaagcgcccuaaaguuagagaccagaaggggcggaucaacuacuauuggacccugcuugaacccggagauacgauuaucuuugaggccaauggcaaccugauugcuccucgcuacgccuucgcucucucuagaggguuuggauccggcaucauuaauagcaacgcccccauggacgagugugaugcgaaaugccagacaccgcaaggcgccaucaauucuagccugccuuuccagaacgugcaucccgugaccaucggggaauguccuaaguauguccgguccgcuaaacuucgcauggugacaggacugagaaauauucccucuauccagagccggggccucuuuggggccauugcuggauucaucgagggcggguggaccggaaugguugacggcugguacggcuaucaccaccagaacgaacaaggguccggauacgccgccgaucaaaagagcacccagaaugcuauuaacggcaucacaaauaaagugaacucugucaucgagaagaugaauacgcaguuuaccgcgguggggaaggaguucaacaaacuggaacgcagaauggagaaucugaacaagaaaguugacgauggauucauugacaucuggacauacaacgccgaacuccuggugcuucuggagaaugaacggacccucgacuuucaugauuccaacgucaagaaucuguaugagaaagucaagagccagcuuaagaacaaugcuaaagaaauuggcaacgggugcuucgaguuuuaccacaaguguaaugacgagugcauggaaucugugaaaaacggcacauaugauuaccccaaguauuccgaggaaagcaaacugaaucgcgagaagaucgacggagugaagcucgaguccaugggcguuuaccagauucuggccaucuauucuaccguggccagcucccugguccuccuggugucucuuggggcuaucagcuucuggaugugcuccaacggaagccugcaguguagaauuugcaucuga

SEQ ID NO: 190993 - RNA, 1701 nt, Artificial Sequence
  derived and/or modified sequence opt5 from hemagglutinin__InfluenzaA__AEX33957
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaguggaggugacaaaugcuaccgaacugguccagaacucuagcacaggcgggaucugcgacuccccgcaccagauccuugauggagagaauuguacccugauugacgcccuccugggcgauccccagugcgacggguuucaaaacaaaaagugggaucuguucguggaaagaucuaaagccuauagcaauuguuacccuuaugacguucccgauuacgcuucccuccggucucugguggccagcuccggaacgcuugaguuuaacaaugaaucuuucaacuggaccggcgucacacagaauggcaccucuuccgcuugcaagcgcgggagcaacaauagcuuuuucuccagacugaacuggcucacacauagcaaguuuaaauauccugcccugaaugugaccaugcccaacaacgaggaguucgacaaacuuuacaucuggggaguucaccauccuggcacggauaaugaccagauuuuucuguaugcgcaggccucugggcggaucacaguguccaccaagcgcagccaacagacagucauuccgaacaucggauccagaccccgggugcgcaauauuccuucuagaaucagcaucuacuggaccauugugaagcccggcgauauccuccugauuaacuccaccgggaaucugaucgcuccucggggauacuucaaaauucgcagcggcaagucuuccaucaugagaagcgacgcccccaucggcaaguguaacucugaaugcauuacaccgaaugggagcaucccuaacgacaaacccuuucagaaugucaaccggauuacguauggagcuuguccucgcuacguuaagcagaauacccucaaacuggccacaggcaugagaaacgugcccgagaagcaaacccgggggaucuucggagcgauugccggcuuuaucgaaaaugggugggagggaaugguggauggcugguauggcuuccgccaccagaacuccgaggggaucggacaggcugccgaccuuaaaucuacacaagcugccauugaucagaucaauggcaagcugaacagacucauugggaaaaccaacgaaaaguuccaccagaucgagaaggaauuuagcgaggucgaaggacggauucaggaccuggagaaauacguggaggauacgaagaucgaccuuugguccuauaaugccgaacugcucguugcucuggagaaccaacauacaauugaucugaccgacagcgaaaugaauaaacucuucgagaagaccaaaaagcagcugagagaaaacgcggaggauaugggcaaugggugcuuuaagaucuaccacaaaugugacaacgccugcaucggcucuauucgcaauggaacauaugaucaugacguguaccgggacgaggcucuuaacaauagauuccagaucaagggcgucgaacugaaauccggguacaaggauuggauucucuggaucagcuuugccauuucuugcuuccugcuuuguguggcccugcucggauuuaucaugugggcuugccagaaaggcaacauccgcuguaauauuugcaucuga

SEQ ID NO: 190994 - RNA, 1701 nt, Artificial Sequence
  derived and/or modified sequence opt5 from hemagglutinin__InfluenzaA__AEX33968
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucugcacgcgcaggccucugggcggauuacaguuuccaccaagcgcagccaacagacagugaucccgaacauuggauccagaccccggguccgcaauaucccuucuagaaucagcauuuauuggaccaucgugaagcccggcgauauucuccugaucaacuccaccgggaaucugauugcuccucggggauacuucaaaauccgcagcggcaagucuuccaucaugagaagcgacgcccccauuggcaaguguaacucugaaugcaucacaccgaaugggagcauuccuaacgacaaacccuuucagaaugugaaccggaucacguacggagcuuguccucgcuaugucaagcagaauacccucaaacuggccacaggcaugagaaacguucccgagaagcaaacccgggggauuuucggagcgaucgccggcuuuaucgaaaaugggugggagggaaugguggauggcugguacggcuuccgccaccagaacuccgaggggauuggacaggcugccgaccuuaaaucuacacaagcugccaucgaucagauuaauggcaagcugaacagacucaucgggaaaaccaacgaaaaguuccaucagauugagaaggaauuuagcgagguggaaggacggauccaggaccuggagaaauaugucgaggauacgaagauugaccuuugguccuacaaugccgaacugcucguggcucuggagaaccaacacacaaucgaucugaccgacagcgaaaugaauaaacucuucgagaagaccaaaaagcagcugagagaaaacgcggaggauaugggcaaugggugcuuuaagaucuaucauaaaugugacaacgccugcauuggcucuauccgcaauggaacauacgaucacgacguuuaucgggacgaggcucuuaacaauagauuccagauuaagggcguggaacugaaauccggguacaaggauuggauccucuggauuagcuuugccaucucuugcuuccugcuuugugucgcccugcucggauuuaucaugugggcuugccagaaaggcaacauucgcuguaauaucugcauuuga

SEQ ID NO: 190995 - RNA, 1701 nt, Artificial Sequence
  derived and/or modified sequence opt5 from hemagglutinin__InfluenzaA__AEX33979
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaacggcguggaacucaaguccggauacaaagauuggauccuguggauuagcuuugccaucucuugcuuccuucugugugucgcccuccugggcuuuaucaugugggcuugccagaaggggaauauucgguguaacaucugcauuuga

SEQ ID NO: 190996 - RNA, 1701 nt, Artificial Sequence
  derived and/or modified sequence opt5 from hemagglutinin__InfluenzaA__AEX33990
augaagaccaucauugcccugagcuacauccucuaucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucgucgagagaagcaaagccuacuccaauugcuauccuuacgacgugcccgauuaugcuucucuccggagccugguugccuccagcgggacgcuugaauuuaacaaugagucuuucaacuggaccggagugacacagaauggcaccuccagcgcuuguauccgcagaucuaacaauuccuuuuucagccggcugaacuggcucacacaucugaaguuuaaguacccugcccuuaaugucaccaugcccaacaacgagaaauucgacaagcuguauauuuggggcgugcaccauccugggacggauaaugaccagaucuuucucuacgcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuauuucaaaauccagagcgggaagucuuccaucaugagaagcgacgcccccauuggaaagugcaacucugaauguaucacaccgaauggcagcauuccuaacgacaaacccuuucagaaugugaaccggaucacguacggcgcuugcccucgcuaugucaagcaagauacccugaaacuugccacagggaugagaaauguucccgagaagcagacccggggaauuuucggcgcgaucgccggguuuaucgaaaacggaugggagggcaugguggacgggugguacggauuccgccaccaaaauuccgagggcauuggccaggcugccgaucugaaaucuacacaggcugccaucgaccagauuaacgggaagcucaauagacugaucggaaaaaccaacgaaaaguuccaccagauugagaaggaauuuagcgagguggaaggccggauccaagaucuugagaaauaugucgaggacacgaagauugaucugugguccuacaacgccgaacuccugguggcucuggagaaucagcauacaaucgaccucaccgauagcgaaaugaacaaacuguucgagaagaccaaaaagcagcuuagagaaaaugcggaggacauggggaacggauguuuuaagaucuaucacaaaugcgauaaugccuguauuggcucuauccgcaacgggacauacgaccaugacguuuaccgggaugaggcucugaauaacagauuccagauuaaguccguggaacucaaaagcggcuauaaggacuggauccuguggauuucuuuugccaucuccugcuuccuucugugcgucgcccuccugggauuuaucaugugggcuugucaaaaaggcaauauucgcugcaacaucuguauuuga

SEQ ID NO: 190997 - RNA, 1701 nt, Artificial Sequence
  derived and/or modified sequence opt5 from hemagglutinin__InfluenzaA__AEX34001
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacucugaauccuucaauuggaccggcgugacacagaacggcaccagcucugcuugcaagcgcagauccaauaacagcuuuuucucucggcugaauuggcucacacaucugaaguuuaaauauccugcccuuaacgucaccaugcccaauaacgagaaguucgacaaacuguacaucuggggagugcaccauccugggacggauaacgaccagauuuuucucuaugcgcaggccuccggccgcaucacaguuagcaccaagagaucccaacagacagugauuccgaauaucgggucucggccccgcgucagaaacauuccuagccggaucuccaucuacuggaccauugugaaacccggagauauccugcugauuaauagcaccggcaaccucaucgcuccucgcggguacuucaagauuagaucuggaaaguccagcaucaugcggucugacgcccccaucggcaaauguaauagcgagugcauuacaccgaacggcuccaucccuaaugacaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggauggaugguauggcuucagacaccagaaugcugagggcaucgggcaggccgcugaccugaagucuacacaagccgccauuaaccagaucaauggaaaacucaaccggcugauuggcaagaccaacgagaaguuccaccagaucgaaaaagaguuuagcgaaguggaggggcgcauucaggaucuugaaaaguacgucgaggacacgaaaaucgaucugugguccuauaaugcugagcuccugguggcgcuggaaaaccaacauacaauugaccucaccgauagcgagaugaauaagcuguucgaaagaaccaaaaagcagcuucgggagaacgccgaagacaugggaaauggcugcuuuaagaucuaccacaaaugugauaacgcuugcaucgggucuauuagaaauggcacauaugaccaugauguuuaccgcgacgaggcccugaacaaucgguuccagaucaagggaguggagcucaaauccggcuacaaggacuggauucuguggaucagcuuugccauuucuugcuuccuucugugugucgcucuccugggguuuaucaugugggccugccagaaaggaaacaucagauguaauauuugcaucuga

SEQ ID NO: 190998 - RNA, 1701 nt, Artificial Sequence
  derived and/or modified sequence opt5 from hemagglutinin__InfluenzaA__AEX34012
augaagaccaucauugcccugagcuacauccucuaucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgagaucugugacucuccgcaccagauccuugauggggaaaauugcacccugauugacgcccuccugggagauccccagugugacggcuuucaaaacaaaaagugggaucuguucgucgagagaagcaaagccuacuccaauugcuauccuuacgacgugcccgauuaugcuucucuccggagccugguugccuccagcgggacgcuugaauuuaacaaugagucuuucaacuggaccggagugacacagaauggcaccuccagcgcuuguauccgcagaucuaacaauuccuuuuucagccggcugaacuggcucacacaucugaaguuuaaguacccugcccuuaaugucaccaugcccaacaacgagaaauucgacaagcuguauauuuggggcgugcaccauccugggacggauaaugaccagaucuuucucuacgcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuauuucaaaauccagagcgggaagucuuccaucaugagaagcgacgcccccauuggaaagugcaacucugaauguaucacaccgaauggcagcauuccuaacgacaaacccuuucagaaugugaaccggaucacguacggcgcuugcccucgcuaugucaagcaaaauacccugaaacuugccacagggaugagaaacguucccgagaagcagacccggggaauuuucggcgcgaucgccggguuuaucgaaaauggaugggagggcaugguggaugggugguacggauuccgccaccagaacuccgagggcauuggccaagcugccgaccugaaaucuacacaggcugccaucgaucagauuaaugggaagcucaacagacugaucggaaaaaccaacgaaaaguuccaccagauugagaaggaauuuagcgagguggaaggccggauccaagaccuugagaaauaugucgaggauacgaagauugaccugugguccuacaaugccgaacuccugguggcucuggagaaccagcauacaaucgaucucaccgacagcgaaaugaauaaacuguucgagaagaccaaaaagcagcuuagagaaaacgcggaggauauggggaauggauguuuuaagaucuaucacaaaugcgacaacgccuguauuggcucuauccgcaaugggacauacgaucaugacguuuaccgggacgaggcucugaacaauagauuccagauuaagggcguggaacucaaauccggauauaaggauuggauccuguggauuagcuuugccaucucuugcuuccuucugugcgucgcccuccugggcuuuaucaugugggcuugucaaaaagggaacauucgcugcaauaucuguauuuga

SEQ ID NO: 190999 - RNA, 1701 nt, Artificial Sequence; identical to SEQ ID NO: 185458
  derived and/or modified sequence opt5 from hemagglutinin__InfluenzaA__AEX34023

SEQ ID NO: 191000 - RNA, 1701 nt, Artificial Sequence
  derived and/or modified sequence opt5 from hemagglutinin__InfluenzaA__AEX34044
augaagaccaucauugccuucagcuacauccugugccucguguuugcucagaaacugcccggcauugacaacuccacagccacgcuuugucuggggcaccaugcggucccuaauggaaccaucguuaagacaauuaccaacgaucaaaucgaggugacaaaugcuaccgaacucgugcagucuagcuccacaggcgggaucugcgacucuccgcaccagauucuggauggagagaacuguacccuuaucgacgcccugcucggcgauccccagugcgacggguuccaaaauaaaaagugggaucuguuugucgaaagaagcaaagccuauuccaacuguuacccuuaugacgugcccgauuacgcuucucugcggagccucguugccuccagcggaacgcuggaguucaauaacgaaucuuuuaauuggaccggcgugacacagaacggcaccuccagcgcuugcaagcgcgggucuaauaacuccuucuuuagcagacuuaauuggcugacacauucuaaguucaaauauccugcccucaacgucaccaugcccaauaacgaggaguuugacaagcuguacauuuggggagugcaccauccuggcacggauaacgaccagaucuuccuuuaugcgcaggccuccgggcggauuacaguuagcaccaaacgcucccaacagacagugaucccgaauauuggaucuagaccccggguccgcaacaucccuagcagaaucuccauuuacuggaccaucgugaagcccggcgauauucugcucaucaauagcaccgggaaccugauugcuccucggggauacuuuaaaauccgcucuggcaaguccagcaucaugagaucugacgcccccauuggcaaguguaauagcgaaugcaucacaccgaacggguccauuccuaaugacaaacccuuccagaacgugaaucggaucacguauggagcuuguccucgcuacgucaagcagaacacccugaaacucgccacaggcaugagaaauguucccgagaagcaaacccgggggauuuuuggagcgaucgccggcuucaucgaaaacgggugggagggaaugguggauggcugguauggcuuccgccaccaaaauucugaggggauuggacaggcugccgaccugaaaagcacacaggcugccaucgaucagauuaacggcaaacuuaauagacugaucgggaagaccaacgaaaaguuucaccagauugagaaggaguucuccgaaguggaaggacggauccaggaccucgagaaauacgucgaggauacgaagauugaccuguggagcuauaacgccgaacuucugguggcucucgagaaucaacauacaaucgaucugaccgacucugaaaugaacaaacuguuugagaagaccaaaaagcagcucagagaaaaugcggaggauaugggcaacgggugcuucaagaucuaccacaaaugugacaaugccugcauuggcuccauccgcaacggaacauaugaucaugacguuuaccgggacgaggcucugaauaacagauuucagauuaagggcguggaacuuaaaagcggguacaaggauuggauccuguggauuucuuucgccaucuccugcuuucuccugugugucgcccuucugggauucaucaugugggcuugccagaaaggcaauauucgcuguaacaucugcauuuga

SEQ ID NO: 191001 - RNA, 1701 nt, Artificial Sequence
  derived and/or modified sequence opt5 from hemagglutinin__InfluenzaA__AEX34089
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcucuaacuccuuuuucagcagacugaauuggcucacacauucuaaguuuaaauauccugcccugaacgucaccaugcccaauaacgaggaguucgacaaacuuuacauuuggggagugcaccauccuggcacggauaacgaccagaucuuucuguaugcgcaggccuccgggcggauuacaguuagcaccaagcgcucccaacagacagugaucccgaauauuggaucuagaccccggguccgcaacaucccuagcagaaucuccauuuacuggaccaucgugaagcccggcgauauucuccugaucaauagcaccgggaaccugauugcuccucggggauacuucaaaauccgcucuggcaaguccagcaucaugagaucugacgcccccauuggcaaguguaauagcgaaugcaucacaccgaacggguccauuccuaaugacaaacccuuucagaacgugaaucggaucacguauggagcuuguccucgcuacgucaagcagaacacccucaaacuggccacaggcaugagaaauguucccgagaagcaaacccgggggauuuucggagcgaucgccggcuuuaucgaaaacgggugggagggaaugguggauggcugguauggcuuccgccaccagaauagcgaggggauuggacaggcugccgaccuuaaaagcacacaagcugccaucgaucagauuaacggcaagcugaauagacucaucgggaaaaccaacgaaaaguuccaccagauugagaaggaauuuuccgagguggaaggacggauccaggaccuggagaaauacgucgaggauacgaagauugaccuuuggagcuauaacgccgaacugcucguggcucuggagaaucaacauacaaucgaucugaccgacucugaaaugaacaaacucuucgagaagaccaaaaagcagcugagagaaaaugcggaggauaugggcaacgggugcuuuaagaucuaccacaaaugugacaaugccugcauuggcuccauccgcaacggaacauaugaucaugacguuuaccgggacgaggcucuuaauaacagauuccagauuaagggcguggaacugaaaagcggguacaaggauuggauccucuggauuucuuuugccaucuccugcuuccugcuuugugucgcccugcucggauuuaucaugugggcuugccagaaaggcaauauucgcuguaacaucugcauuuga

SEQ ID NO: 191002 - RNA, 1701 nt, Artificial Sequence
  derived and/or modified sequence opt5 from hemagglutinin__InfluenzaA__AEX34123
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucuguaugcgcaggccucugggcggauuacaguuuccaccaagcgcagccaacagacagugaucccgaacauuggauccagaccccggguccgcaauaucccuucuagaaucagcauuuacuggaccaucgugaagcccggcgauauucuccugaucaacuccaccgggaaucugauugcuccucggggauacuucaaaauccgcagcggcaagucuuccaucaugagaagcgacgcccccauuggcaaguguaacucugaaugcaucacaccgaaugggagcauuccuaacgacaaacccuuucagaaugugaaccggaucacguauggagcuuguccucgcuacgucaagcagaauacccucaaacuggccacaggcaugagaaacguucccgagaagcaaacccgggggauuuucggagcgaucgccggcuuuaucgaaaaugggugggagggaaugguggauggcugguauggcuuccgccaccagaacuccgaggggauuggacaggcugccgaccuuaaaucuacacaagcugccaucgaucagauuaauggcaagcugaacagacucaucgggaaaaccaacgaaaaguuccaccagauugagaaggaauuuagcgagguggaaggacggauccaggaccuggagaaauacgucgaggauacgaagauugaccuuugguccuauaaugccgaacugcucguggcucuggagaaccaacauacaaucgaucugaccgacagcgaaaugaauaaacucuucgagaagaccaaaaagcagcugagagaaaacgcggaggauaugggcaaugggugcuuuaagaucuaccacaaaugugacaacgccugcauuggcucuauccgcaauggaacauaugaucaugacguuuaccgggacgaggcucuuaacaauagauuccagauuaagggcguggaacugaaauccggguacaaggauuggauccucuggauuagcuuugccaucucuugcuuccugcuuugugucgcccugcucggauuuaucaugugggcuugccagaaaggcaacauucgcuguaauaucugcauuuga

SEQ ID NO: 191003 - RNA, 1701 nt, Artificial Sequence
  derived and/or modified sequence opt5 from hemagglutinin__InfluenzaA__AEX34134
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauccgcagaucuaacaauuccuuuuucagccggcugaacuggcucacccaucugaaguuuaaguauccugcccuuaaugucacaaugcccaacaacgagaaauucgacaagcuguacauuuggggcgugcaccauccugggaccgauaaugaccagaucuuucucuaugcgcaggccucuggacgcauuacgguuuccacaaaaagaagccaacagaccgugaucccgaacauuggcucccggccccgcgucagaaauaucccuucucggaucagcauuuacuggacaaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucaccccgaauggcagcauuccuaacgacaaacccuuucagaaugugaaccgcaucacauauggcgcuuguccuagauacgucaagcagaauacgcugaaacuugccaccgggaugcggaacguucccgagaagcaaacacgcggaauuuucggcgcgaucgccggguuuaucgaaaauggaugggagggcaugguggaugggugguauggauucagacaccagaacuccgagggcauuggccaggcugccgaccugaaaucuacccaagcugccaucgaucagauuaaugggaagcucaaccggcugaucggaaaaacaaacgaaaaguuccaccagauugagaaggaauuuagcgagguggaaggcagaauccaggaccuugagaaauacgucgaggauaccaagauugaccugugguccuauaaugccgaacuccugguggcucuggagaaccaacauacgaucgaucucacagacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggaccuaugaucaugacguuuacagagacgaggcucugaacaaucgcuuccagauuaagggcguggaacucaaauccggauacaaggauuggauccuguggauuagcuuugccaucucuugcuuccuucugugugucgcccuccugggcuuuaucaugugggcuugccagaaagggaacauucgguguaauaucugcauuuga

SEQ ID NO: 191004 - RNA, 1701 nt, Artificial Sequence; identical to SEQ ID NO: 191002
  derived and/or modified sequence opt5 from hemagglutinin__InfluenzaA__AEX34145

SEQ ID NO: 191005 - RNA, 1701 nt, Artificial Sequence
  derived and/or modified sequence opt5 from hemagglutinin__InfluenzaA__AEX34156
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgggucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucaacuggaccggcgugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgauaagcuguacauuuggggagugcaccauccugggacggacaaugaucagaucuuucucuaugcgcaggccucuggccgcauuacaguuuccaccaaaagaagccaacagacagugaucccgaacauugggucccggccccgcgucagaaauaucccuucucggaucagcauuuacuggaccaucgugaagcccggagacauucugcugaucaacuccaccggcaaucucauugcuccucgcggguacuucaaaaucagaagcggaaagucuuccaucaugcggagcgaugcccccauuggcaaguguaacucugaaugcaucacaccgaauggcagcauuccuaacgacaaacccuuucagaaugugaaccgcaucacguauggggcuuguccuagauacgucaagcagaauacccugaaacuugccacaggaaugcggaacguucccgagaagcaaacccgcggcauuuucggggcgaucgccggauuuaucgaaaauggcugggaggggaugguggacggaugguauggcuucagacaccagaacuccgagggcacagggcaggcugccgaucugaaaucuacccaagcugccauugaccagaucaauggaaagcucaaccggcugauuggcaaaacgaacgaaaaguuccaccagaucgagaaggaauuuagcgagguggaagggcgcauucaggaucuugagaaauacgucgaggacacaaagaucgaucugugguccuauaaugccgaacuccugguggcucuggagaaccaacauaccauugaccucaccgauagcgaaaugaauaaacuguucgagaagaccaaaaagcagcuuagagaaaacgcggaggacaugggaaauggcugcuuuaagaucuaccacaaaugugauaacgccugcaucgggucuauucggaauggcacauaugaccaugauguuuacagagacgaggcucugaacaaucgcuuccagaucaagggaguggaacucaaauccggcuacaaggacuggauucuguggaucagcuuugccauuucuugcuuccuucugugugucgugcuccugggguuuaucaugugggccugccagaaaggaaacauccgguguaauauuugcaucuga

SEQ ID NO: 191006 - RNA, 1701 nt, Artificial Sequence; identical to SEQ ID NO: 184952
  derived and/or modified sequence opt5 from hemagglutinin__InfluenzaA__AEX34178

SEQ ID NO: 191007 - RNA, 1701 nt, Artificial Sequence
  derived and/or modified sequence opt5 from hemagglutinin__InfluenzaA__AEX34188
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacaucucaaauucaaguauccugcccugaacgucaccaugcccaacaaugagaacuuugacaaacuuuacauuuggggcgugcaccauccugggacggauaaugaccagaucuuccuguaugcgcaggccucuggacgcauuacaguuuccaccaagagaagccaacagacagugaucccgaacauuggcucccggccccgcgucagaaauaucccuucucggaucagcauuuacuggaccaucgugaagcccggggauauucuccugaucaacuccaccggaaaucugauugcuccucgcggcuacuuuaaaaucagaagcgggaagucuuccaucaugcggagcgacgcccccauuggaaaauguaacucugaaugcaucacaccgaauggcagcauuccuaacgacaagcccuuccagaaugugaaccgcaucacguauggcgcuuguccuagauacgucaagcagaauacccucaaacuggccacagggaugcggaacguucccgagaagcaaacccgcggaauuuuuggcgcgaucgccggguucaucgaaaauggaugggagggcaugguggaugggugguauggauucagacaccagaacuccgagggcauuggccaggcugccgaccuuaaaucuacacaagcugccaucgaucagauuaacgggaagcugaaucggcucaucggaaaaaccaacgaaaaguuucaccagauugagaaagaguucagcgaaguggaaggcagaauccaggaccuggagaaguacgucgaggauacgaagauugaccuuugguccuauaaugccgaacugcucguggcucuggagaaccaacauacaaucgaucugaccgacagcgaaaugaauaaacucuuugagaagaccaaaaagcagcugcgcgaaaacgcggaggauauggggaauggaugcuucaaaaucuaccacaagugugacaacgccugcauuggcucuauccggaaugggacauaugaucaugacguuuacagagacgaggcucuuaacaaucgcuuucagauuaagggcguggaacugaaauccggauacaaggauuggauccucuggauuagcuucgccaucucuugcuuucugcuuuguaucgcccugcucggcuucauuaugugggcuugccagaaagggaacauccgguguaauauuugcaucuga

SEQ ID NO: 191008 - RNA, 1701 nt, Artificial Sequence; identical to SEQ ID NO: 185458
  derived and/or modified sequence opt5 from hemagglutinin__InfluenzaA__AEX34199

SEQ ID NO: 191009 - RNA, 1701 nt, Artificial Sequence
  derived and/or modified sequence opt5 from hemagglutinin__InfluenzaA__AEX34221
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauuggaccggcgugacacagaacggcaccuccagcgcuugcaagcgcgggucuaauaacuccuuuuucagcagacugaauuggcucacacauucuaaguuuaaauauccugcccugaacgucaccaugcccaauaacgaggaguucgacaaacuuuacauuuggggagugcaccauccuggcacggauaacgaccagaucuuucuguaugcgcaggccuccgggcggauuacaguuagcaccaagcgcucccaacagacagugaucccgaauauuggaucuagaccccggguccgcaacaucccuagcagaaucuccauuuacuggaccaucgugaagcccggcgauauucuccugaucaauagcaccgggaaccugauugcuccucggggauacuucaaaauccgcucuggcaaguccagcaucaugagaucugacgcccccauuggcaagugugacagcgaaugcaucacaccgaauggguccauuccuaacgauaaacccuuucagaaugugaaccggaucacguauggagcuuguccucgcuacgucaagcagaauacccucaaacuggccacaggcaugagaaacguucccgagaagcaaacccgggggauuuucggagcgaucgccggcuuuaucgaaaaugggugggagggaaugguggacggcugguauggcuuccgccaccagaacucugaggggauuggacaggcugccgaucuuaaaagcacacaagcugccaucgaccagauuaauggcaagcugaacagacucaucgggaaaaccaaugaaaaguuccaccagauugagaaggaauuuuccgagguggaaggacggauccaggaucuggagaaauacgucgaggacacgaagauugaucuuuggagcuauaacgccgaacugcucguggcucuggagaaccaacauacaaucgaccugaccgauucugaaaugaauaaacucuucgagaagaccaaaaagcagcugagagaaaacgcggaggacaugggcaaugggugcuuuaagaucuaccacaaaugugauaacgccugcauuggcuccauccgcaauggaacauaugaccaugacguuuaccgggaugaggcucuuaacaauagauuccagauuaagggcguggaacugaaaagcggguacaaggacuggauccucuggauuucuuuugccaucuccugcuuccugcuuugugucgcccugcucggauuuaucaugugggcuugccagaaaggcaacauucgcuguaauaucugcauuuga

SEQ ID NO: 191010 - RNA, 1701 nt, Artificial Sequence; identical to SEQ ID NO: 184952
  derived and/or modified sequence opt5 from hemagglutinin__InfluenzaA__AEX34243

SEQ ID NO: 191011 - RNA, 1701 nt, Artificial Sequence; identical to SEQ ID NO: 191007
  derived and/or modified sequence opt5 from hemagglutinin__InfluenzaA__AEX34254

SEQ ID NO: 191012 - RNA, 1701 nt, Artificial Sequence; identical to SEQ ID NO: 184952
  derived and/or modified sequence opt5 from hemagglutinin__InfluenzaA__AEX34265

SEQ ID NO: 191013 - RNA, 1701 nt, Artificial Sequence
  derived and/or modified sequence opt5 from hemagglutinin__InfluenzaA__AEX34275
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcugcacccuggcacggauaaugaccagaucuuucucuaugcgcaggccucugggcggauuacaguuuccaccaagcgcagccaacagacagugaucccgaacauuggauccagaccccggguccgcaauaucccuucuagaaucagcauuuacuggaccaucgugaagcccggcgauauucugcugaucaacuccaccgggaaucucauugcuccucggggauacuucaaaauccgcagcggcaagucuuccaucaugagaagcgacgcccccauuggcaaguguaacucugaaugcaucacaccgaaugggagcauuccuaacgacaaacccuuucagaaugugaaccggaucacguauggagcuuguccucgcuacgucaagcagaauacccugaaacuugccacaggcaugagaaacguucccgagaagcaaacccgggggauuuucggagcgaucgccggcuuuaucgaaaaugggugggagggaaugguggauggcugguauggcuuccgccaucagaacuccgaggggauuggacaggcugccgaccugaaaucuacacaagcugccaucgaucagauuaauggcaagcucaacagacugaucgggaaaaccaacgaaaaguuccaccagauugagaaggaauuuagcgagguggaaggacggauccaggaccuugagaaauacgucgaggauacgaagauugaccugugguccuauaaugccgaacuccugguggcucuggagaaccaacacacaaucgaucucaccgacagcgaaaugaauaaacuguucgagaagaccaaaaagcagcuuagagaaaacgcggaggauaugggcaaugggugcuuuaagaucuaccauaaaugugacaacgccugcauuggcucuauccgcaauggaacauaugaucacuacguuuaccgggacgaggcucugaacaauagauuccagauuaagggcguggaacucaaauccggguauaaggacuggauccuguggauuagcuuugccaucucuugcuuccuucugugugucgcccuccugggauuuaucaugugggcuugccagaaaggcaacauucgcuguaauaucugcauuuga

SEQ ID NO: 191014 - RNA, 1698 nt, Artificial Sequence; identical to SEQ ID NO: 185512
  derived and/or modified sequence opt5 from hemagglutinin__InfluenzaA__AEX34318

SEQ ID NO: 191015 - RNA, 1698 nt, Artificial Sequence
  derived and/or modified sequence opt5 from hemagglutinin__InfluenzaA__AEX34329
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuguguccaaagagucuuggagcuacaucgucgaaaagccgaaccccgagaauggcaccuguuauccugggcauuuugccgauuacgaggaacugagagagcaacucuccucugugagcuccuucgaacgguuugagauuuuccccaaggagagcucuuggccuaaccacacgguuaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguccuggugcucuggggagugcaccacccuccgaacaucggcgaccagaaagcccuguaccauaccgagaaugcuuacgucagcguuguguccucucacuauagcagaaaguucacacccgaaaucgccaagcggccuaaagugcgcgaucaggaggggagaauuaacuacuauuggacccuucuggagcccggagacacgaucauuuuugaagcgaauggcaaccucaucgccccucgguacgcuuucgcccugucccgcggguuuggaagcggcauuaucaauucuaacgcucccauggauaagugugacgccaaaugccagacaccgcaaggcgcgauuaauuccagccuuccuuuccagaacguccaucccgugaccaucggggaguguccuaaguauguuagaucugccaaacugcggauggugacaggacuccgcaauauccccagcauucaguccagaggccuguuuggggcuaucgccggauucauugaaggcggguggaccggaauggucgauggcugguacggcuaucaccaccagaacgagcaagggucuggauacgcugccgaccaaaagagcacccagaaugccaucaacggcauuacaaauaaagugaacuccguuaucgaaaagaugaauacgcaguuuaccgcuguggggaaggaguucaacaaacuggagcggcgcauggaaaaccucaauaagaaagucgaugacggauucaucgauauuuggacauacaacgcggagcugcuugugcugcucgaaaaugagagaacccuggacuuucaugacagcaacgucaagaaucuuuaugaaaaagugaagucucagcugaagaacaaugccaaagagaucggcaacgggugcuucgaguuuuaccacaaguguaaugaugaaugcauggaguccguuaaaaacggcacauaugacuaccccaaguauagcgaagagucuaaacucaaucgggagaagauugaaggagugaagcuggaguccaugggcgucuaccagauccuggcuauuuauagcaccguggccuccucucucguucugcuugugagccugggggccaucuccuucuggaugugcucuaacggaagccuccagugucgcaucugcauuuga

SEQ ID NO: 191016 - RNA, 1701 nt, Artificial Sequence
  derived and/or modified sequence opt5 from hemagglutinin__InfluenzaA__AEX34352
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauucugaacgacaaaccuuuucagaaugugaaccgcaucacguauggcgcuugucccagauacgucaagcagaauacccuuaaacuggccacagggaugcggaacguuccugagaagcaaacccgcggaauuuucggcgcgaucgccggguuuaucgaaaauggaugggagggcaugguggaugggugguauggauucagacaccagaacuccgagggcauuggccaggcugccgaccucaaaucuacacaagcugccaucgaucagauuaaugggaagcugaaccggcuuaucggaaaaaccaacgaaaaguuccaccagauugagaaggaauuuagcgagguggaaggcagaauccaggaccuggagaaauacgucgaggauacgaagauugaccucugguccuauaaugccgaacugcugguggcucucgagaaccaacauacaaucgaucugaccgacagcgaaaugaauaaacuuuucgagaagaccaaaaagcagcugcgcgaaaacgcggaggauauggggaauggaugcuuuaagaucuaccacaaaugugacaacgccugcauuggcucuauccggaaugggacauaugaucaugacguuuacagagacgaggcucucaacaaucgcuuccagauuaagggcguggaacugaaauccggauacaaggauuggauccuuuggauuagcuuugccaucucuugcuuccugcucugugucgcccugcugggcuuuaucaugugggcuugccagaaagggaacauucgguguaauaucugcauuuga

SEQ ID NO: 191017 - RNA, 1701 nt, Artificial Sequence; identical to SEQ ID NO: 185458
  derived and/or modified sequence opt5 from hemagglutinin__InfluenzaA__AEX34364

SEQ ID NO: 191018 - RNA, 1701 nt, Artificial Sequence; identical to SEQ ID NO: 185458
  derived and/or modified sequence opt5 from hemagglutinin__InfluenzaA__AEX34375

SEQ ID NO: 191019 - RNA, 1701 nt, Artificial Sequence
  derived and/or modified sequence opt5 from hemagglutinin__InfluenzaA__AEX34386
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucaucgagagaagcaaagccuauuccaauuguuacccuuaugacguccccgauuacgcuucucuccggagccugguggccuccagcgggacgcuugaauuuaacaaugagucuuucaacuggaccggaguuacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguccaccauccugggacggauaaugaccagauuuuucucuaugcgcaagccucuggacgcaucacaguguccaccaagagaagccagcagacaguuauuccgaacaucggcucccggccccgcgugagaaauaucccuucucggauuagcaucuacuggaccauugucaaacccggggauauccugcugauuaacuccaccggaaaucucaucgcuccucgcggcuacuucaagaucagaagcgggaaaucuuccauuaugcggagcgacgcccccaucggaaaguguaacucugaaugcauuacaccgaauggcagcaucccuaacgacaagcccuuucagaaugugaaccgcauuacguauggcgcuuguccuagauacgugaaacaaaauacccugaaacuugccacagggaugcggaacguccccgagaagcagacccgcggaaucuucggcgcgaucgccggguuuauugaaaauggaugggagggcaugguugaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgagguggaaggccgcauccaagaccuugagaaguacguggaggauacgaaaauugaccugugguccuauaaugccgaacuccuggucgcucuggagaaccagcauacaaucgaucucaccgacagcgaaaugaauaagcuguucgagaaaaccaagaaacagcuucgggaaaacgcggaggauauggggaauggaugcuuuaagaucuaccacaagugugacaacgccugcauuggcucuaucagaaaugggacauaugaucaugacguguaccgcgacgaggcucugaacaaucgguuccagauuaaaggcguugaacucaaguccggauacaaagauuggauccuguggauuagcuuugccaucucuugcuuccuucuguguguggcccuccugggcuuuaucaugugggcuugccaaaaggggaacauuagauguaauaucugcauuuga

SEQ ID NO: 191020 - RNA, 1701 nt, Artificial Sequence
  derived and/or modified sequence opt5 from hemagglutinin__InfluenzaA__AEX34407
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauccgcagaucuaacaauuccuuuuucagccggcugaacuggcucacccaucugaaguuuaaguauccugcccuuaaugucacaaugcccaacaacgagcaguucgacaaacuguacauuuggggcgugcaccauccugggaccgauaaugaccagaucuuucucuaugcgcaagccucuggacgcauuacgguuuccacaaagagaagccagcagaccgugaucccgaacauuggcucccggccccgcgucagaaauaucccuucucggaucagcauuuacuggacaaucgugaaacccggggauauucugcugaucaacuccaccggaaaucucauugcuccucgcggcuacuucaagauccugagcgggaaaucuuccaucaugagaagcgacgcccccauuggaaaguguaacucugaaugcaucaccccgaauggcagcauuccuaacgacaagcccuuucagaaugugaaccggaucacauauggcgcuuguccucgcuacgucaaacaaaauacgcuuaagcuggccaccgggaugagaaacguucccgagaaacagacacggggaauuuucggcgcgaucgccggguuuaucgaaaauggaugggagggcaugguggaugggugguauggauuccgccaccagaacuccgagggcagaggccaagcugccgaccucaagucuacccaggcugccauugaucagaucaaugggaaacugaaccggcuuauuggaaagacaaacgaaaaauuccaccagaucgagaaggaauuuagcgagguggaaggccgcauucaagaccuggagaaguacgucgaggauaccaaaguggaccucugguccuauaaugccgaacugcugguugcucucgagaaccagcauacgaucgaucugacagacagcgaaaugaauaaacuuuucgagaagaccaagaaacagcugagagaaaacgcggaggauauggggaauggaugcuuuaagauuuaccacaagugugacaacgccugcaucggcucuauccggaaugggaccuaugaucaugacguguacagagacgaggcucucaacaaucgcuuccagauuaaaggcgucgaacugaaguccggauacaaagauuggauccuuuggauuagcuuugccaucucuugcuuccugcucuguguggcccugcugggcuuuauuaugugggcuugccaaaaggggaacauccgguguaauaucugcauuuga

SEQ ID NO: 191021 - RNA, 1698 nt, Artificial Sequence
  derived and/or modified sequence opt5 from hemagglutinin__InfluenzaA__AEX34440
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaccuccagagagucuuggagcuacaucguggaaaaaccgaaucccgagaacggcacguguuauccugggcauuuugccgacuacgaggaacugcgggagcaacucuccucugucagcuccuucgaacgcuuugagauuuuccccaaggagagcucuuggccuaaucacaccacaaccggaguguccgccagcugcucucauaacggcgaauccagcuuuuauaagaaucugcuuuggcugacaggcaaaaacgggcucuaccccaaucugucuaaguccuaugcuaacaauaaagagaaggaaguucuggugcucuggggaguccaccacccuccgaacaucggcaaccagagagcccuguaccauaccgagaaugcuuacgugagcguggucuccucucacuauagccggaaauucacgcccgaaaucgccaagcgcccuaagguuagagaucaggaggggcggauuaacuacuauuggacacuucuggagcccggagacaccaucauuuuugaagcgaauggcaaccucaucgccccucgcuacgcuuucgcccuguccagaggguuuggaagcggcauuaucaauucuaacgcucccauggaugagugugacgccaaaugccagacaccgcaaggcgcgauuaauuccagccuuccuuuccagaacgugcaucccgugaccaucggggaauguccuaaguauguccggucugccaaacugcgcauggugaccggacucagaaauauccccagcauucagucccggggccuguuuggggcuaucgccggauucauugagggcggguggacaggaaugguugauggcugguacggcuaucaccaccagaacgaacaagggucuggauacgcugccgaccaaaagagcacgcagaaugccaucaacggcauuaccaauaaagugaacuccgucaucgagaagaugaauacacaguuuaccgcuguggggaaagaguucaacaagcuggaacgcagaauggagaaccucaauaagaaaguugaugacggauucaucgauauuuggacauacaacgcggaacugcuugugcugcucgagaaugaacggacccuggacuuucaugacagcaacgucaagaaucuuuaugagaaagugaagucucagcugaaaaacaaugccaaggagaucggcaacgggugcuucgaauuuuaccacaaguguaaugaugagugcauggaauccgucaaaaacggcacguaugacuaccccaaguauagcgaggagucuaaacucaaucgcgaaaagauugauggagugaaacuggaguccaugggcguuuaccagauccuggcuauuuauagcacaguggccuccucucucguccugcuugugagccugggggccaucuccuucuggaugugcucuaacggaagccuccaguguagaaucugcauuuga

SEQ ID NO: 191022 - RNA, 1698 nt, Artificial Sequence; identical to SEQ ID NO: 183323
  derived and/or modified sequence opt5 from hemagglutinin__InfluenzaA__AEX34462

SEQ ID NO: 191023 - RNA, 1698 nt, Artificial Sequence
  derived and/or modified sequence opt5 from hemagglutinin__InfluenzaA__AEX34473
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaucugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauaugcuuucgcccugagccggggguuuggaucuggcaucauuaccuccaaugcucccauggacgaaugugaugccaagugccagacaccgcaaggcgcgaucaacagcucucuuccuuuccagaaugugcaccccgucaccaucggggaguguccuaaauacguuaagagcgccaaacugcgcauggugaccggacucagaaacauucccuccauccagucucggggccuguuuggggcuauugccggauucaucgaaggcggguggacaggaaugguggacggcugguauggcuaccaucaccagaaugagcaagggagcggauacgcugccgaucagaaguccacgcagagcgccauuaacggcaucaccaauaaagucaacucugugaucgaaaagaugaauacacaguuuaccgcuguugggaaagaguucaacaagcuggagcgcagaauggaaaaucucaacaagaaaguggacgauggauuccuggacauuuggacauauaaugcggagcuucugguccuccuggaaaacgagcggacccuugacuuucacgauuccaacgugaagaaucuguacgaaaaagucaagagccaacucaaaaacaaugccaaggagaucggcaacgggugcuucgaguuuuaucauaaguguaaugacgaaugcauggagucugugaaaaacggcacguacgauuaucccaaguacuccgaagagagcaaacugaaucgcgagaagauugacggaguuaaacuggaauccaugggcguguaucagauccucgcuauuuacucuacagucgccagcucccuggugcuucugguuucucucggggccaucagcuucuggaugugcuccaacggaagccugcaguguagaaucugcauuuga

SEQ ID NO: 191024 - RNA, 1698 nt, Artificial Sequence
  derived and/or modified sequence opt5 from hemagglutinin__InfluenzaA__AEX34495
augaaggugaaacugcucguccugcuuugcaucuucaccgccacauacgcugacacgauuuguaucggcuaucacgccaacaauagcaccgauacaguugacaccgugcuggagaagaacgugacagucacccauuccgugaaucuccuggaagauucucacaacgggaaacuuugccugcucaagggaauugcgccccugcagcugggcaauuguagcguugcuggguggauccucggaaacccugagugcgaacugcuuauuuccaaagagucuuggagcuacaucguggaaacaccgaaucccgagaacggcaccuguuauccuggguacuuugccgacuaugaggaacugagagagcaacucuccucugucagcuccuucgaacgguuugagaucuuccccaaggagagcucuuggccuaaucauacggugaccggaguuuccgccagcugcucucacaacggcaaguccagcuuuuaccgcaaucugcuuuggcugacaggcaaaucugggcucuaucccaaccuguccaagagcuacgcuaauaacaaagaaaaggaggugcugguccucuggggagugcaucacccuccgaauauuggcgugcagagagcccuguaccacaccgaaaacgcuuaugucuccguugugucuagccauuacucccggcgcuucacacccgagaucgccaaaagaccuaaggugcgggaucaggaagggcgcauuaacuauuacuggacccuucuggagcccggagacacgaucauuuuugaggcgaauggcaaccucaucgccccuagauaugcuuucgcccugagccggggguuuggaucuggcauuaucacauccaaugcucccauggaugaaugugacgccaagugccagaccccgcaaggcgcgaucaacagcucucuuccuuuccagaauguccaccccgugacaauuggggaguguccuaaauacguuaagagcgccaaacugcgcauggugaccggacucagaaacauccccuccauucagucucggggccuguuuggggcuaucgccggauucauugaaggcggguggaccggaauggucgauggcugguauggcuaccaucaccagaaugagcaagggagcggauacgcugccgaccagaaguccacacagaacgccaucaauggcaucacgaacaaagugaauagcguuauugaaaagaugaacacccaguuuacagcuguggggaaagaguucaauaagcuggagcgcagaauggaaaaccucaauaagaaagucgaugacggauuccuggauaucuggaccuauaacgcggagcuucuggugcuccuggaaaacgagcggacacuugacuuucacgacucuaaugucaagaaccuguacgaaaaagugaagucccaacucaaaaauaacgccaaggagauuggcaaugggugcuucgaguuuuaucauaaguguaacgaugaaugcauggagagcguuaaaaauggcaccuacgacuaucccaaguacucugaagaguccaaacugaaccgcgagaagaucgauggagugaaacuggaaagcaugggcgucuaucagauucucgcuaucuacuccacgguggccucuagccugguucuucuggugucccucggggccaucucuuucuggaugugcagcaauggaucccugcaguguagaauuugcaucuga

SEQ ID NO: 191025 - RNA, 1698 nt, Artificial Sequence; identical to SEQ ID NO: 191024
  derived and/or modified sequence opt5 from hemagglutinin__InfluenzaA__AEX34506

SEQ ID NO: 191026 - RNA, 1698 nt, Artificial Sequence; identical to SEQ ID NO: 191024
  derived and/or modified sequence opt5 from hemagglutinin__InfluenzaA__AEX34517

SEQ ID NO: 191027 - RNA, 1698 nt, Artificial Sequence; identical to SEQ ID NO: 191024
  derived and/or modified sequence opt5 from hemagglutinin__InfluenzaA__AEX34528

SEQ ID NO: 191028 - RNA, 1698 nt, Artificial Sequence; identical to SEQ ID NO: 191024
  derived and/or modified sequence opt5 from hemagglutinin__InfluenzaA__AEX34539

SEQ ID NO: 191029 - RNA, 1698 nt, Artificial Sequence; identical to SEQ ID NO: 191024
  derived and/or modified sequence opt5 from hemagglutinin__InfluenzaA__AEX34550

SEQ ID NO: 191030 - RNA, 1698 nt, Artificial Sequence; identical to SEQ ID NO: 191024
  derived and/or modified sequence opt5 from hemagglutinin__InfluenzaA__AEX34561

SEQ ID NO: 191031 - RNA, 1698 nt, Artificial Sequence; identical to SEQ ID NO: 191024
  derived and/or modified sequence opt5 from hemagglutinin__InfluenzaA__AEX34572

SEQ ID NO: 191032 - RNA, 1698 nt, Artificial Sequence; identical to SEQ ID NO: 191024
  derived and/or modified sequence opt5 from hemagglutinin__InfluenzaA__AEX34583

SEQ ID NO: 191033 - RNA, 1698 nt, Artificial Sequence; identical to SEQ ID NO: 191024
  derived and/or modified sequence opt5 from hemagglutinin__InfluenzaA__AEX34594

SEQ ID NO: 191034 - RNA, 1698 nt, Artificial Sequence; identical to SEQ ID NO: 191024
  derived and/or modified sequence opt5 from hemagglutinin__InfluenzaA__AEX34605

SEQ ID NO: 191035 - RNA, 1698 nt, Artificial Sequence; identical to SEQ ID NO: 191024
  derived and/or modified sequence opt5 from hemagglutinin__InfluenzaA__AEX34616

SEQ ID NO: 191036 - RNA, 1698 nt, Artificial Sequence; identical to SEQ ID NO: 191024
  derived and/or modified sequence opt5 from hemagglutinin__InfluenzaA__AEX34627

SEQ ID NO: 191037 - RNA, 1698 nt, Artificial Sequence; identical to SEQ ID NO: 191024
  derived and/or modified sequence opt5 from hemagglutinin__InfluenzaA__AEX34638

SEQ ID NO: 191038 - RNA, 1698 nt, Artificial Sequence
  derived and/or modified sequence opt5 from hemagglutinin__InfluenzaA__AEX34650
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagaagccuguaccacacagaaaaugccuauguguccgucguuucuagccauuacucccggcgcuucacccccgagauugcuaaaagaccuaaggugcgggaucaggaagggcgcaucaacuauuacuggacgcuucuggagcccggagacacaauuaucuuugaggccaauggcaaccucauugcgccuagauucgccuuugcucugagccggggguucggaucuggcaucauuaccuccaaugcccccauggaugaaugugacgcuaagugccagacaccgcaaggcgccaucaacagcucucuuccuuuucagaaugugcaccccgucaccaucggggaguguccuaaauaugugcgcagcgcgaagcugagaaugguuaccggacuccggaacauucccuccauccagucucgcggccuguucggggccauugcuggauuuaucgaaggcggguggacaggaaugguggauggcugguacggcuaucaucaccagaaugagcaagggagcggauacgccgcugaccagaaauccacgcagaacgccauuaauggcaucaccaacaaggucaauagcgugaucgaaaagaugaacacacaguucaccgccguugggaaagaguucaauaaacuggagagacggauggaaaaccucaacaagaagguggaugacggauuucuggauauuuggacauacaaugcugagcuucugguccuccuggaaaacgagcgcacccuugacuuccacgacucuaaugugaaaaaccuguaugaaaaggucaaaucccaacucaagaauaacgcgaaagagaucggcaaugggugcuuugaguucuaccauaaguguaacgaugaaugcauggagagcgugaagaauggcacguaugacuaccccaaauauucugaagaguccaagcugaacagagagaaaauugauggaguuaagcuggaaagcaugggcguguaccagauccucgccauuuauuccacagucgcuucuagccuggugcuucugguuucccucggggccaucucuuuuuggaugugcagcaauggaucccugcagugucggaucugcauuuga

SEQ ID NO: 191039 - RNA, 1698 nt, Artificial Sequence
  derived and/or modified sequence opt5 from hemagglutinin__InfluenzaA__AEX34661
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaaggggcucuaucccaaccugucuaaauccuacgcuaauaacaaggaaaaagaggugcugguccucuggggagugcaucacccuccgaauaucggcgaucagagagcccuguaccacacagaaaacgcuuaugugagcgucguuuccucucauuacagccggcgcuucacccccgagauugccaagagaccuaaggugcgggaccaggaagggcgcaucaacuauuacuggacgcuucuggagcccggagauacaauuaucuuugaggcgaauggcaaccucauugccccuagauucgcuuuugcccugucccggggguucggaagcggcaucauuaccucuaaugcucccauggacgaaugugaugccaaaugccagacaccgcaaggcgcgaucaacuccagccuuccuuuucagaaugugcaccccgucaccaucggggaguguccuaaguaugugcgcucugccaaacugagaauggcuaccggacuccggaacauucccagcauccagucccgcggccuguucggggccauugcuggauuuaucgaaggcggguggacaggaaugguugacggcugguacggcuaucaucaccagaaugagcaagggucuggauacgccgccgaucagaaaagcacgcagaacgcuauuaauggcaucaccaaaaaggugaacuccgucaucgaaaagaugaauacacaguucaccgcgguggggaaggaguucagcaagcuggagagacggauggaaaaccucaauaaaaagguugacgauggauuucuggacauuuggacauacaacgccgagcuucuggugcuccuggaaaaugagcgcacccuugacuuccacgauucuaacgucaaaaaccuguaugaaaaggugaaaucccaacucaagaauaacgcuaaggagaucggcaaugggugcuuugaguucuaccauaaauguaacgacgaaugcauggagagcgucaagaauggcacguaugauuaccccaaauauucugaagaguccaagcugaacagagagaaaauugacggagugaagcuggaaagcaugggcguuuaccagauccucgccauuuauuccacaguggccucuagccugguccuucuggugucccucggggcuaucucuuuuuggaugugcagcaauggaucccugcagugucggaucugcauuuga

SEQ ID NO: 191040 - RNA, 1698 nt, Artificial Sequence
  derived and/or modified sequence opt5 from hemagglutinin__InfluenzaA__AEX34672
augaaggugaaacugcucguccugcuuugcaccuucacagccacguacgcugacaccaucuguauuggcuaucacgccaacaauagcacagauaccguugacacagugcuggauaagaacgugaccgucacacauuccgugaaucuccuggaggacucucacaacgggaaacuuugccugcucaagggaaucgcgccccugcagcugggcaauuguagcguugcuggguggauucucggaaacccugaaugcgagcugcuuaucuccagagaaucuuggagcuacauuguggagaaaccgaaucccgaaaacggcaccuguuauccugggcauuuugccgauuacgaggagcugcgggaacaacucuccucugucagcuccuucgagcgcuuugaaaucuuccccaaggagagcucuuggccuaaucacacgaccacaggaguguccgccagcugcucucaugacggcgaguccagcuuuuauaagaaccugcuuuggcugaccggcaaaaaugggcucuaccccaaccugucuaaguccuaugcuaauaacaaagaaaaggagguucuggugcucuggggaguccaccacccuccgaauaucggcgugcagagagcccuguaccauacagaaaacgcuuacgugagcgucguuuccucucacuauagccggaaauucacccccgagauugccaagcgcccuaaggugagagaucaggaagggcggaucaacuacuauuggacgcuucuggagcccggagacacaauuaucuuugaggcgaauggcaaccucauugccccucgcuacgcuuucgcccuguccagaggguuuggaagcggcaucauuaauucuaacgcucccauggaugaaugugacgccaaaugccagaccccgcaaggcgcgaucaauuccagccuuccuuuccagaacgugcaucccgucacaaucggggaguguccuaaguaugugcggucugccaaacugcgcaugguuaccggacucagaaauauucccagcauccagucccggggccuguuuggggcuauugccggauucaucgaaggcggguggaccggaaugguggauggcugguacggcuaucaccaccagaacgagcaagggucuggauacgcugccgaccaaaagagcacacagaaugccauuaacggcaucacgaauaaagucaacuccgugaucgaaaagaugaauacccaguuuacagcuguugggaaagaguucaacaagcuggagcgcagaauggaaaaucucaacaagaaaguggaugacggauucauugacaucuggaccuacaacgcggagcugcuuguccugcucgaaaaugagcggacacuggauuuucaugacagcaacgugaagaaucuuuaugaaaaagucaagucucagcugaaaaacaaugccaaggagauuggcaacgggugcuucgaguuuuaccacaaguguaaugaugaaugcauggaguccgugaaaaacggcaccuaugacuaccccaaguauagcgaagagucuaaacucaaucgcgagaagaucgauggaguuaaacuggaauccaugggcguguaccagauucuggcuaucuauagcacggucgccuccucucucgugcugcuuguuagccugggggccaucuccuucuggaugugcucuaacggaagccuccaguguagaauuugcaucuga

SEQ ID NO: 191041 - RNA, 1698 nt, Artificial Sequence
  derived and/or modified sequence opt5 from hemagglutinin__InfluenzaA__AEX34683
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuuaucacacgaccacaggaguguccgccagcugcucucauaauggcgaauccagcuuuuacaagaaccugcuuuggcugaccggcaaaaaugggcucuaucccaaccugucuaaguccuacgcuaauaacaaagagaaggaaguucuggugcucuggggaguccaccacccuccgaauaucggcgaucagagagcccuguaccauacagagaacgcuuaugugagcguggucuccucucacuacagccggaaauucacccccgaaauugccaagcgcccuaagguuagagaccaggaggggcggaucaacuauuacuggacgcuucuggagcccggagauacaauuaucuuugaagcgaauggcaaccucauugccccucgcuaugcuuucgcccuguccagaggguuuggaagcggcaucauuaauucuaacgcucccauggacgagugugaugccaaaugccagaccccgcaaggcgcgaucaauuccagccuuccuuuccagaacgugcaucccgugacaaucggggaauguccuaaguacguccggucugccaaacugcgcauggugaccggacucagaaauauucccagcauccagucccggggccuguuuggggcuauugccggauucaucgagggcggguggaccggaaugguugacggcugguauggcuaccaccaccagaacgaacaaggguuuggauacgcugccgaucagaagucuacacagaaugccauuaacggcaucacgaauaaagugaacagcgucaucgagaagaugaauacccaguucacagcuguggggaaagaguucaacaagcuggaacgcagaauggagaaucucaacaagaaaguugacgauggauuuauugacaucuggaccuauaacgcggaacugcuugugcugcucgagaaugaacggacacuggacuuccaugauuccaacgucaagaaucuuuacgagaaagucaagagccaacugaaaaacaaugccaaggagauuggcaacgggugcuuugaguucuaucacaaguguaaugacgaaugcauggaaucugugaaaaacggcaccuacgauuaucccaaguacuccgaggagagcaaacucaaucgcgaaaagaucgacggagugaaacuggagucuaugggcguuuaucagauucuggcuaucuacuccacgguggccagcucccucguccugcuugugucucugggggccaucagcuuuuggaugugcuccaacggaucucuccaguguagaauuugcaucuga

SEQ ID NO: 191042 - RNA, 1698 nt, Artificial Sequence
  derived and/or modified sequence opt5 from hemagglutinin__InfluenzaA__AEX34757
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcggcuccagcuuuuauaagaaucugcuuuggcugaccagaaagaacgggcucuaccccaaucugucuaaguccuaugcuaacaauaaagaaaaggagguucuggugcucuggggaguccaccacccuccgaacaucggcgaucagcgggcccuguaccauacagaaaacgcuuacgugagcguggucuccucucacuauagccgcaaauucacccccgagauugccaagagaccuaagguucgggaccaggaagggcgcaucaauuacuauuggacgcuucuggagcccggagauacaauuaucuuugaggcgaacggcaaucucauugccccuagauacgcuuucgcccugucccggggguuuggaagcggcaucauuaacucuaaugcucccauggacgaaugugaugccaaaugccagaccccgcaaggcgcgaucaacuccagccuuccuuuccagaaugugcaucccgugacaaucggggaguguccuaaguauguccgcucugccaaacugagaauggugaccggacuccggaacauucccagcauccagucccgcggccuguuuggggcuauugccggauucaucgaaggcggguggaccggaaugguugacggcugguacggcuaucaccaccagaaugagcaagggucuggauacgcugccgaucagaaaagcacacagaacgccauuaauggcaucacgaacaaagucaauuccgugaucgaaaagaugaacacccaguuuacagcuguggggaaagaguucaauaagcuggagagacggauggaaaaccucaacaagaaaguugacgauggauucauugacaucuggaccuacaaugcggagcugcuugugcugcucgaaaacgagcgcacacuggacuuucaugauagcaaugucaagaaccuuuaugaaaaagugaagucucaacugaaaaauaacgccaaggagauuggcaaugggugcuucgaguuuuaccacaaguguaacgacgaaugcauggaguccgucaaaaauggcaccuaugauuaccccaaguauagcgaagagucuaaacucaacagagagaagaucgacggagugaaacuggaauccaugggcguuuaccagauucuggcuaucuauagcacgguggccuccucucucguccugcuugugagccugggggccaucuccuucuggaugugcucuaauggaagccuccagugucggauuugcaucuga

SEQ ID NO: 191043 - RNA, 1698 nt, Artificial Sequence
  derived and/or modified sequence opt5 from hemagglutinin__InfluenzaA__AEX34768
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggauagcucuuggccuaaucacacgaccacaggaguguccgccagcugcucucauaacggcgaguccagcuuuuauaagaaucugcuuuggcugaccggcaaaaacgggcucuaccccaaucugucuaaguccuaugcuaacaauaaagaaaaggagguucuggugcucuggggaguccaccacccuccgaacaucggcgaccagagagcccuguaccauacagaaaacgcuuacgugagcguggucuccucucacuauagccggaaauucacccccgagauugccaagcgcccuaagguuagagaucaagggggacggaucaauuacuauuggacgcuucuggaacccggcgacacaauuaucuuugaggcgaacgggaaucucauugccccucgcuacgcuuucgcccuguccagaggauuuggcagcggcaucauuaacucuaaugcucccauggaugagugugacgccaaaugccagaccccgcagggggcgaucaacuccagccuuccuuuccagaaugugcaucccgugacaaucggagaauguccuaaguauguccggucugccaaacugcgcauggugaccggccucagaaacauucccagcauccagucccgggggcuguuuggagcuauugccggcuucaucgaagggggauggaccggcaugguugauggcugguacggguaucaccaccagaaugaacaaggaucuggcuacgcugccgaccagaaguccacacagaacgccauuaaugggaucacgaacaaagugaauagcgucaucgagaagaugaacacccaguuuacagcugugggaaaagaguucaauaagcuggagcgcagaauggagaaccucaacaagaaaguugaugacggcuucauugacaucuggaccuacaaugcggaacugcuugugcugcucgagaacgaacggacacuggauuuucaugacagcaaugucaagaaccuuuaugagaaagugaagucucaacugaaaaauaacgccaaggaaauugggaauggcugcuucgaguuuuaccacaaguguaacgaugagugcauggaauccgucaaaaauggaaccuaugacuaccccaaguauagcgaggaaucuaaacucaaccgcgagaagaucgauggcgugaaacuggaguccauggggguuuaccagauucuggcuaucuauagcacgguggccuccucucucguccugcuugugagccugggagccaucuccuucuggaugugcucuaauggcagccuccaguguagaauuugcaucuga

SEQ ID NO: 191044 - RNA, 1698 nt, Artificial Sequence
  derived and/or modified sequence opt5 from hemagglutinin__InfluenzaA__AEX34779
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaacgcuccuuuuauagaaaccugcuuuggcugacaggcaaaaaugggcucuaccccaaccugagcaagucuuaugcuaauaacaaagagaaggaagugcugguccucuggggagugcaccacccuccgaacaucggcaaucagaaagcccuguaccauaccgagaacgcuuacguguccgucguuagcucccacuauucucggaaguucacacccgaaauugccaagcgcccuaaagugagagaccaggaggggcggaucaauuacuauuggacccuucuggagcccggagauacgauuaucuuugaagcgaacggcaaucucauugccccucgcuacgcuuucgcccugagcagaggguuuggauccggcaucauuaacagcaaugcucccauggacaagugugaugccaaaugccagacaccgcaaggcgcgaucaacucuucccuuccuuuccagaaugugcaucccgucaccaucggggaguguccuaaguaugugcggagcgccaaacugcgcaugguuacaggacucagaaacauucccucuauccagagccggggccuguuuggggcuauugccggauucaucgaaggcggguggaccggaaugguggacggcugguacggcuaucaccaccagaaugagcaaggguccggauacgcugccgaucagaagucuacccagaacgccauuaauggcaucacaaacaaagucaauagcgugaucgaaaagaugaacacgcaguuuaccgcuguugggaaggaguucaacaaacuggagcgcagaauggaaaaucucaacaagaaaguggacgauggauucauugacaucuggacauacaaugcggagcugcuuguccugcucgaaaacgagcggacccuggauuuucaugacuccaaugugaagaaccuuuaugaaaaagucaagagccaacugaagaauaacgccaaagagauuggcaaugggugcuucgaguuuuaccacaaguguaacgacgaaugcauggagucugugaaaaauggcacauaugauuaccccaaguauuccgaagagagcaaacucaaccgcgagaagaucgacggaguuaagcuggaaucuaugggcguguaccagauucuggcuaucuauuccaccgucgccagcucccucgugcugcuuguuucucugggggccaucagcuucuggaugugcuccaauggaucucuccaguguagaauuugcaucuga

SEQ ID NO: 191045 - RNA, 1698 nt, Artificial Sequence; identical to SEQ ID NO: 187121
  derived and/or modified sequence opt5 from hemagglutinin__InfluenzaA__AEX34790

SEQ ID NO: 191046 - RNA, 1698 nt, Artificial Sequence
  derived and/or modified sequence opt5 from hemagglutinin__InfluenzaA__AEX34801
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcgccuguuauccugggcauuuugccgacuacgaggaacugagagagcaacucagcuccgucucuagcuucaagcgguuugaaaucuuccccaaagaguccagcuggccuaaccacaccgugacgggaguuucugcuuccugcagccauaauggcgagucuuccuuuuauaagaaccugcuuuggcugaccggcaaaaaugggcucuaccccaaccugagcaagucuuaugccaauaacaaagaaaaggaggugcugguccucuggggagugcaccacccuccgaacaucggcgaucagaugacacuguaccauaaggaaaaugcuuacguguccgucguuagcucccacuauucucgcaaauucacccccgagauugccaagagaccuaaagugcgggaccaggaagggcgcaucaacuacuauuggacacuucuggagcccggagauaccauuaucuuugaggcgagcggcaaucucauugccccuagauacgcuuucgcccugucccggggguuuggaagcggcaucauuaacucugacgcucccauggaugaaugugacgccaagugccagacgccgcaaggcgcgaucaauuccagccuuccuuuccagaacgugcaucccgucacaaucggggaguguccuaaauaugugcgcucugccaagcugagaaugguuaccggacuccggaauauucccagcauccagucccgcggccuguuuggggcuauugccggauucaucgaaggcggguggacaggaaugguggauggcugguacggcuaucaccaccagaacgagcaagggucuggauacgcugccgaccagaaaagcacccagaaugccauuaacggcaucaccaauaaggucaacuccgugaucgaaaagaugaauacacaguuuacggcuguugggaaagaguucaacaagcuggagagacggauggaaaaucucaacaaaaagguggaugacggauucauugacgucuggaccuacaacgcggagcugcuugugcugcucgaaaaugagcgcacacuggauuuucaugacagcaacgucaaaaaucuuuaugaaaaggugaagaaccaacugaaaaauaacgccaaggagaucggcaaugggugcuucgaguuuuaccacaaauguaacgaugaaugcauggagucuguuaagaauggcaccuaugacuaccccaaauauuccgaagagagcaagcucucuagagagaagauugauggagugaaacuggaauccaugggcgucuaccagauccuggcuauuuauagcacaguggccuccucucucguucugcuugugagccugggggccaucuccuucuggaugugcucuaacggaagccuccagugucggaucugcauuuga

SEQ ID NO: 191047 - RNA, 1698 nt, Artificial Sequence
  derived and/or modified sequence opt5 from hemagglutinin__InfluenzaA__AEX34812
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauugauggcaucacaaacaaagucaauuccgugaucgaaaagaugaacacgcaguuuaccgcuguugggaaggaguucaauaaacuggagcggcgcauggaaaaccucaacaagaaaguggacgauggauucauugacaucuggacauacaaugcggagcugcuuguccugcucgaaaacgagagaacccuggacuuucaugauagcaaugugaagaaccuuuaugaaaaagucaagucucagcugaagaauaacgccaaagagauuggcaaugggugcuucgaguuuuaccacaaguguaacgacgaaugcauggaguccgugaaaaauggcacauaugauuaccccaaguauagcgaagagucuaaacucaaccgggagaagaucgacggaguuaagcuggaauccaugggcguguaccagauucuggcuaucuauagcaccgucgccuccucucucgugcugcuuguuagccugggggccaucuccuucuggaugugcucuaauggaagccuccagugucgcauuugcaucuga

SEQ ID NO: 191048 - RNA, 1698 nt, Artificial Sequence
  derived and/or modified sequence opt5 from hemagglutinin__InfluenzaA__AEX34834
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaacagcaaagaguccuggucuuacaucguggaaaagccgaaucccgagaacggcaccuguuauccugggcauuuugccgacuacgaggaacugagagagcaacucagcuccgucucuagcuucaagcgguuugaaauuuuccccaaagaguccagcuggccuaaucacacggugaccggaguuucugccuccugcagccauaacggcgagucuuccuuuuauaagaaucugcuuuggcugacaggcaaaaacgggcucuaccccaaucugagcaagucuuaugcuaacaacaaagaaaaggaggugcugguccucuggggagugcaccacccuccgaauaucggcgaucagaugacccuguaccauaaggaaaacgccuacguguccgucguuagcucccacuauucucgcaaauucacacccgagaucaccaagagaccuaaagugcgggaccaggaagggcgcauuaauuacuauuggacgcuucuggagcccggagauacaaucauuuuugaggcuagcggcaaccucaucgccccuagauacgcguucgcccugucccggggguuuggaagcggcauuaucaauucuaacgcucccauggacgaaugugaugccaagugccagaccccgcaaggcgcuauuaauuccagccuuccuuuccagaacgugcaucccgucacaaucggggaguguccuaaauaugugcgcucugccaagcugagaaugguuaccggacuccggaauauccccagcauucagucccgcggccuguuuggggcgaucgccggauucauugaaggcggguggaccggaaugguggacggcugguacggcuaucaccaccagaacgagcaagggucuggauacgcugccgaucagaaaagcacacagaaugcuaucaacggcauuacgaauaaggucaacuccgugaucgaaaagaugaauacccaguuuacagccguugggaaagaguucaacaagcuggagagacggauggaaaaccucaauaaaaagguggacgauggauucaucgacgucuggaccuacaacgccgagcugcuugugcugcucgaaaaugagcgcacacuggacuuucaugauagcaacgucaaaaaucuuuaugaaaaggugaagaaccaacugaaaaauaacgcuaaggagauuggcaaugggugcuucgaguuuuaccacaaauguaacgacgaaugcauggagucuguuaagaauggcaccuaugauuaccccaaauauuccgaagagagcaagcucucuagagagaagaucgacggagugaaacuggaauccaugggcgucuaccagauucuggcgaucuauagcacgguggccuccucucucguucugcuugugagccugggggcuauuuccuucuggaugugcucuaacggaagccuccagugucggaucugcaucuga

SEQ ID NO: 191049 - RNA, 1698 nt, Artificial Sequence
  derived and/or modified sequence opt5 from hemagglutinin__InfluenzaA__AEX34845
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuugugccgaaagaguccuggucuuacaucgucgaaaagcccaacccugagaauggcaccuguuaucccgggcauuuugccgauuacgaggaacugagagagcaacucagcuccgugucuagcuucgaacgguuugagauuuucccuaaggaguccagcuggcccaaccacacgguuaccggagugucugccuccugcagccauaauggcgaaucuuccuuuuaucgcaaccugcuuuggcugacaggcaaaaaugggcucuacccuaaccugagcaagucuuaugcuaauaacaaagagaaggaaguccuggugcucuggggagugcaccacccgcccaacaucggcgaccagaaagcccuguaccauaccgagaaugcuuacgucuccguugugagcucccacuauucuagaaaguucacaccugaaaucgccaagcggcccaaagugcgcgaucaggaggggagaauuaacuacuauuggacccuucuggagccuggagacacgaucauuuuugaagcgaauggcaaccucaucgcuccccgguacgccuucgcccugagccgcggguuuggauccggcauuaucaauagcaacgcuccgauggauaagugugacgccaaaugccagacaccucaaggcgcgauuaauucuucccuucccuuccagaacguccauccugugaccaucggggagugucccaaguauguuagaagcgccaaacugcggauggugacaggacuccgcaauauccccucuauucagagcagaggccuguuuggggcuaucgccggauucauugaaggcggguggaccggaauggucgauggcugguacggcuaucaccaccagaacgagcaaggguccggauacgcugccgaccagaagucuacccagaaugccaucaacggcauuacaaauaaagugaacagcguuaucgaaaagaugaauacgcaguuuaccgcuguggggaaggaguucaacaaacuggagcggcgcauggaaaaccucaauaagaaagucgaugacggauucaucgauauuuggacauacaacgcggagcugcuugugcugcucgaaaaugagagaacccuggacuuucaugacuccaacgucaagaaucuuuaugaaaaaguuaagagccaacugaagaacaaugccaaagagaucggcaacgggugcuucgaguuuuaccacaaguguaaugaugaaugcauggagucugugaaaaacggcacauaugacuacccuaaguauuccgaagagagcaaacucaaucgggagaagauugaaggagugaagcuggagucuaugggcgucuaccagauccuggcuauuuauuccaccguggccagcucccucguucugcuugugucucugggggccaucagcuucuggaugugcuccaacggaucucuccagugucgcaucugcauuuga

SEQ ID NO: 191050 - RNA, 1698 nt, Artificial Sequence; identical to SEQ ID NO: 187121
  derived and/or modified sequence opt5 from hemagglutinin__InfluenzaA__AEX34856

SEQ ID NO: 191051 - RNA, 1698 nt, Artificial Sequence
  derived and/or modified sequence opt5 from hemagglutinin__InfluenzaA__AEX34867
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuguguccaaagagucuuggagcuacaucgucgaaaagccgaaccccgagaauggcaccuguuauccugggcauuuugccgauuacgaggaacugagagagcaacucauuuccgugucuagcuucgaacgguuugagaucuuccccaaggaguccagcuggccuaaccacacgguuaccggagugucugccuccugcagccauaauggcgaaucuuccuuuuaucgcaaccugcuuuggcugacaggcaaaaaugggcucuaccccaaccugagcaagucuuaugcuaauaacaaagagaaggaaguccuggugcucuggggagugcaccacccuccgaacaucggcgaccagaaagcccuguaccauaccgagaaugcuuacgucuccguugugagcucccacuauucuagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugagccgcggguuuggauccggcaucauuaauagcaacgcucccauggauaagugugacgccaaaugccagacaccgagaggcgcgaucaauucuucccuuccuuuccaaaacguccaucccgugaccaucggggaguguccuaaguauguucggagcgccaaacugcgcauggugacaggacucagaaauauucccucuauccagagccggggccuguuuggggcuauugccggauucaucgaaggcggguggaccggaauggucgauggcugguacggcuaucaccaccagaacgagcagggguccggauacgcugccgaccaaaagucuacccagaaugccauuaacggcaucacaaauaaagugaacagcguuaucgaaaagaugaauacgcaguuuaccgcuguggggaaggaguucaacaaacuggagcgcagaauggaaaaccucaauaagaaagucgaugacggauucauugauaucuggacauacaacgcggagcugcuugugcugcucgaaaaugagcggacccuggacuuucaugacuccaacgucaagaaucuuuaugaaaaaguuaagagccagcugaagaacaaugccaaagagauuggcaacgggugcuucgaguuuuaccacaaguguaaugaugaaugcauggagucugugaaaaacggcacauaugacuaccccaaguauuccgaagagagcaaacucaaucgcgagaagaucgaaggagugaagcuggagucuaugggcgucuaccaaauucuggcuaucuauuccaccguggccagcucccucguucugcuugugucucugggggccaucagcuucuggaugugcuccaacggaucucuccaguguagaauuugcaucuga

SEQ ID NO: 191052 - RNA, 1698 nt, Artificial Sequence; identical to SEQ ID NO: 187121
  derived and/or modified sequence opt5 from hemagglutinin__InfluenzaA__AEX34878

SEQ ID NO: 191053 - RNA, 1698 nt, Artificial Sequence
  derived and/or modified sequence opt5 from hemagglutinin__InfluenzaA__AEX34889
augaaggugaaccugcucguccugcuuugcaccuucacagccacguacgcugacaccaucuguauuggcuaucacgccaauaacagcacagauaccguugacacagugcuggagaaaaaugugaccgucacacauuccgugaaccuccuggaaaauucucacaacgggaaacuuugccugcucaaaggaaucgcgccccugcagcugggcaauuguagcguugcuggguggauucucggaaacccugagugcgaacugcuuaucuccaaggagucuuggagcuacauuguggaaaaaccgaaucccgagaacggcaccuguuauccugggcauuuugccgauuacgaggaacugagagagcaacucuccucugucagcuccuucgaacgguuugagaucuuccccaaggagagcucuuggccuaaucacacggugaccggaguuuccgccagcugcucucauaacggcgaauccagcuuuuaucgcaaucugcuuuggcugacaggcaagaacgggcucuaccccaaucugucuaaauccuaugcuaacaacaaggagaaagaagugcugguccucuggggagugcaccacccuccgaauaucggcgaccagaaggcccuguaccauaccgagaacgcuuacgugagcgucguuuccucucacuauagcagaaaauucacacccgaaauugccaagcggccuaaggugcgcgaucaggaggggagaaucaauuacuauuggacccuucuggagcccggagacacgauuaucuuugaagcgaacggcaaucucauugccccucgguacgcuuucgcccugucccgcggguuuggaagcggcaucauuaacucuaaugcucccauggauaaaugugacgccaagugccagacaccgcaaggcgcgaucaacuccagccuuccuuuccagaaugugcaucccgucaccaucggggaguguccuaaauaugugagaucugccaagcugcggaugguuacaggacuccgcaacauucccagcauccaguccagaggccuguuuggggcuauugccggauucaucgaaggcggguggaccggaaugguggauggcugguacggcuaucaccaccagaaugagcaagggucuggauacgcugccgaccagaaaagcacccagaacgccauuaauggcaucacaaacaaggucaauuccgugaucgaaaagaugaacacgcaguuuaccgcuguugggaaggaguucaacaagcuggagcggcgcauggaaaaucucaacaaaaagguggaugacggauucauugauaucuggacauacaaugcggagcugcuuguccugcucgaaaacgagagaacccuggacuuucaugacagcaaugugaaaaaccuuuaugaaaaggucaaaucucaacugaagaauaacgccaaggagauuggcaaugggugcuucgaguuuuaccacaaauguaacgaugaaugcauggaguccgugaagaauggcacauaugacuaccccaaauauagcgaagagucuaagcucaaccgggagaaaaucgauggaguuaagcuggaauccaugggcguguaccagauucuggcuaucuauagcaccgucgccuccucucucgugcugcuuguuagccugggggccaucuccuucuggaugugcucuaauggaagccuccagugucgcauuugcaucuga

SEQ ID NO: 191054 - RNA, 1698 nt, Artificial Sequence
  derived and/or modified sequence opt5 from hemagglutinin__InfluenzaA__AEX34900
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcgaucagaugacccuguaccauaaggagaaugccuacguguccgucguuagcucccacuauucucgcaaguucacacccgaaauugcuaaaagaccuaaggugcgggaccaggaggggcgcaucaacuacuauuggacccuucuggagcccggagauacgauuaucuuugaagccagcggcaaucucauugcgccuagauacgccuucgcucugucccggggguuuggaagcggcaucauuaacucuaaugcccccauggacgagugugaugcuaaaugccagacaccgcaaggcgccaucaacuccagccuuccuuuccagaaugugcaucccgucaccaucggggaauguccuaaguaugugcgcucugcgaaacugagaaugguuacaggacuccggaacauucccagcauccagucccgcggccuguuuggggccauugcuggauucaucgagggcggguggaccggaaugguggacggcugguacggcuaucaccaccagaaugaacaagggucuggauacgccgcugaucagaaguccacccagaacgccauuaauggcgucacaaacaaagugaauagcguuaucgagaagaugaacacgcaguuuaccgccguggggaaggaguucaauaaacuggaaagacggauggagaaccucaacaagaaagucgacgauggauucaucgacguguggacauacaaugcugaacugcuuguccugcucgagaacgaacgcacccuggacuuucaugauagcaaugugaagaaccuuuaugagaaaguuaagaaucaacugaagaacaaugcgaaagagauuggcaacgggugcuucgaauuuuaccacaaguguaaugacgagugcauggaaucugugaaaaacggcacauaugauuaccccaaguauuccgaggagagcaaacucucuagagaaaagaucgacggagucgagcuggaauccaugggcguguaccagauucuggccaucuauagcaccguugcuuccucucucgugcugcuugucagccugggggccauuuccuucuggaugugcucuaauggaagccuccagugucggaucugcaucuga

SEQ ID NO: 191055 - RNA, 1698 nt, Artificial Sequence
  derived and/or modified sequence opt5 from hemagglutinin__InfluenzaA__AEX34911
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucucccaagagucuuggagcuacauuguggaaaaaccgaaccccgagaauggcaccuguuauccugggcauuuugccgauuacgaggaacugagagagcagcucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaagaaugggcucuaccccaaccugucuaaauccuaugcuaauaacaaggagaaagaagugcugguccucuggggagugcaccacccuccgaacaucggcgaccagaaggcccuguaccauaccgagaaugcuuacgugagcgucguuuccucucacuauagcagaaaauucacacccgaaauugccaagcggccuaaggugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaaaugugacgccaagugccaaacaccgcagggcgcgaucaauuccagccuuccuuuccagaacgugcaucccgucaccaucggggaguguccuaaauaugugagaucugccaagcugcggaugguuacaggacuccgcaauauucccagcauccaguccagaggccuguuuggggcuauugccggauucaucgaaggcggguggaccggaaugguggauggcugguacggcuaucaccaccaaaacgagcaggggucuggauacgcugccgaccagaaaagcacccagaaugccauuaacggcaucacaaauaaggucaacuccgugaucgaaaagaugaauacgcaauuuaccgcuguugggaaagaguucaacaagcuggagcggcgcauggaaaaccucaauaaaaagguggaugacggauucauugauaucuggacauacaacgcggagcugcuuguccugcucgaaaaugagagaacccuggacuuucaugacagcaacgugaaaaaucuuuaugaaaaggucaaaucucagcugaagaacaaugccaaggagauuggcaacgggugcuucgaguuuuaccacaaauguaaugaugaaugcauggaguccgugaagaacggcacauaugacuaccccaaauauagcgaagagucuaagcucaaucgggagaaaaucgauggaguuaagcugggcuccauggggguguaccagauucuggcuaucuauagcaccgucgccuccucucucgugcugcuuguuagccugggagccaucuccuucuggaugugcucuaacggcagccuccaaugucgcauuugcaucuga

SEQ ID NO: 191056 - RNA, 1698 nt, Artificial Sequence
  derived and/or modified sequence opt5 from hemagglutinin__InfluenzaA__AEX34922
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagacgguucacacccgaaauugccaagcgcccuaaggugagagaucaggaggggcggaucaacuacuauuggacccuucuggagcccggagacacgauuaucuuugaagcgaauggcaaccucauugccccucgcuacgcuuucgcccuguccagaggguuuggaagcggcaucauuaauucuaacgcucccauggauaaaugugacgccaagugccagacaccgcaaggcgcgaucaauuccagccuuccuuuccagaacgugcaucccgucaccaucggggaguguccuaaauaugugcggucugccaagcugcgcaugguuacaggacucagaaauauucccagcauccagucccggggccuguuuggggcuauugccggauucaucgaaggcggguggaccggaaugguggauggcugguacggcuaucaccaccagaacgagcaagggucuggauacgcugccgaccagaaaagcacccagaaugccauuaacggcaucacaaauaaggucaacuccgugaucgaaaagaugaauacgcaguuuaccgcuguugggaaagaguucaacaagcuggagcgcagaauggaaaaccucgauaaaaagguggacgauggauucauugacaucuggacauacaaugcggagcugcuuguccugcucgaaaacgagcggacccuggacuuucaugauagcaaugugaaaaaccuuuaugaaaaggucaaaucucaacugaagaauaacgccaaggagauuggcaaugggugcuucgaguuuuaccacaaauguaacgacgaaugcauggaguccgugaagaauggcacauaugauuaccccaaauauagcgaagagucuaagcucaaccgcgagaaaaucgacggaguuaagcuggaauccaugggcguguaccagauucuggcuaucuauagcaccgucgccuccucucucgugcugcuuguuagccugggggccaucuccuucuggaugugcucuaauggaagccuccaguguagaauuugcaucuga

SEQ ID NO: 191057 - RNA, 1698 nt, Artificial Sequence; identical to SEQ ID NO: 185512
  derived and/or modified sequence opt5 from hemagglutinin__InfluenzaA__AEX34933

SEQ ID NO: 191058 - RNA, 1698 nt, Artificial Sequence; identical to SEQ ID NO: 185512
  derived and/or modified sequence opt5 from hemagglutinin__InfluenzaA__AEX34944

SEQ ID NO: 191059 - RNA, 1698 nt, Artificial Sequence
  derived and/or modified sequence opt5 from hemagglutinin__InfluenzaA__AEX34955
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaaaacucucacaaugggaaacuuugccugcucaagggaaucgcuccccugcagcugggcaacuguagcguggccggguggauucucggaaauccugagugcgaacugcuuaucuccaaagagucuuggagcuacauuguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgcuagcugcucucauaauggcgaauccagcuuuuaucgcaaccugcuuuggcugacaggcaaaaaugggcucuaccccaaccugucuaaguccuaugccaauaacaaagagaaggaaguucuggugcucuggggaguccaccacccuccgaacaucggcgaccagaaagcucuguaccauaccgagaaugccuacgugagcguggucuccucucacuauagcagaaaguucacacccgaaauugcgaagcggccuaaaguucgcgaucaggaggggagaaucaacuacuauuggacccuucuggagcccggagacacgauuaucuuugaagccaauggcaaccucauugcuccucgguacgccuucgcucugucccgcggguuuggaagcggcaucauuaauucuaacgcccccauggauaagugugacgcgaaaugccagacaccgcaaggcgccaucaauuccagccuuccuuuccagaacgugcaucccgugaccaucggggaguguccuaaguaugucagaucugcuaaacugcggauggugacaggacuccgcaauauucccagcauccaguccagaggccuguuuggggccauugcuggauucaucgaaggcggguggaccggaaugguugauggcugguacggcuaucaccaccagaacgagcaagggucuggauacgccgccgaccaaaagagcacccagaaugcuauuaacggcaucacaaauaaagugaacuccgucaucgaaaagaugaauacgcaguuuaccgcgguggggaaggaguucaacaaacuggagcggcgcauggaaaaccucaauaagaaaguugaugacggauucauugauaucuggacauacaacgccgagcugcuugugcugcucgaaaaugagagaacccuggacuuucaugacagcaacgucaagaaucuuuaugaaaaagugaagucucagcugaagaacaaugcuaaagagauuggcaacgggugcuucgaguuuuaccacaaguguaaugaugaaugcauggaguccgucaaaaacggcacauaugacuaccccaaguauagcgaagagucuaaacucaaucgggagaagaucgauggagugaagcuggaauccaugggcguuuaccagauucuggccaucuauagcaccguggccuccucucucguccugcuugugagccugggggcuaucuccuucuggaugugcucuaacggaagccuccagugucgcauuugcaucuga

SEQ ID NO: 191060 - RNA, 1698 nt, Artificial Sequence
  derived and/or modified sequence opt5 from hemagglutinin__InfluenzaA__AEX34966
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuauguuugaagcgaauggcaaccucaucgccccucgguacgcuuucgcccugucccgcggguuuggaagcggcauuaucaauucuaacgcucccauggauaagugugacgccaaaugccagacaccgcaaggcgcgauuaauuccagccuuccuuuccagaacgugcaucccgucaccaucggggaguguccuaaguaugugagaucugccaaacugcggaugguuacaggacuccgcaauauccccagcauucaguccagaggccuguuuggggcuaucgccggauucauugaaggcggguggaccggaaugguggauggcugguacggcuaucaccaccagaacgagcaagggucuggauacgcugccgaccaaaagagcacccagaaugccaucaacggcauuacaaauaaagucaacuccgugaucgaaaagaugaauacgcaguuuaccgcuguugggaaggaguucaacaaacuggagcggcgcauggaaaaccucaauaagaaaguggaugacggauucaucgauauuuggacauacaacgcggagcugcuuguccugcucgaaaaugagagaacccuggacuuucaugacagcaacgugaagaaucuuuaugaaaaagucaagucucagcugaagaacaaugccaaagagaucggcaacgggugcuucgaguuuuaccacaaguguaaugaugaaugcauggaguccgugaaaaacggcacauaugacuaccccaaguauagcgaagagucuaaacucaaucgggagaagauugauggaguuaagcuggaauccaugggcguguaccagauccuggcuauuuauagcaccgucgccuccucucucgugcugcuuguuagccugggggccaucuccuucuggaugugcucuaacggaagccuccagugucgcaucugcauuuga

SEQ ID NO: 191061 - RNA, 1698 nt, Artificial Sequence; identical to SEQ ID NO: 191060
  derived and/or modified sequence opt5 from hemagglutinin__InfluenzaA__AEX34977

SEQ ID NO: 191062 - RNA, 1698 nt, Artificial Sequence; identical to SEQ ID NO: 191060
  derived and/or modified sequence opt5 from hemagglutinin__InfluenzaA__AEX34988

SEQ ID NO: 191063 - RNA, 1698 nt, Artificial Sequence; identical to SEQ ID NO: 187121
  derived and/or modified sequence opt5 from hemagglutinin__InfluenzaA__AEX34999

SEQ ID NO: 191064 - RNA, 1698 nt, Artificial Sequence; identical to SEQ ID NO: 191060
  derived and/or modified sequence opt5 from hemagglutinin__InfluenzaA__AEX35010

SEQ ID NO: 191065 - RNA, 1698 nt, Artificial Sequence; identical to SEQ ID NO: 191060
  derived and/or modified sequence opt5 from hemagglutinin__InfluenzaA__AEX35032

SEQ ID NO: 191066 - RNA, 1698 nt, Artificial Sequence; identical to SEQ ID NO: 191060
  derived and/or modified sequence opt5 from hemagglutinin__InfluenzaA__AEX35043

SEQ ID NO: 191067 - RNA, 1698 nt, Artificial Sequence
  derived and/or modified sequence opt5 from hemagglutinin__InfluenzaA__AEX35054
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuauguuugaagcgaauggcaaccucaucgccccucgguacgcuuucgcccugaaucgcggguuuggauccggcauuaucaacagcaaugcucccauggauaagugugacgccaaaugccagacaccgcaaggcgcgauuaacucuucccuuccuuuccagaaugugcaucccgucaccaucggggaguguccuaaguaugugagaagcgccaaacugcggaugguuacaggacuccgcaacauccccucuauucagagcagaggccuguuuggggcuaucgccggauucauugaaggcggguggaccggaaugguggauggcugguacggcuaucaccaccagaaugagcaaggguccggauacgcugccgaccagaagucuacccagaacgccaucaauggcauuacaaacaaagucaauagcgugaucgaaaagaugaacacgcaguuuaccgcuguugggaaggaguucaacaaacuggagcggcgcauggaaaaucucaacaagaaaguggaugacggauucaucgauauuuggacauacaaugcggagcugcuuguccugcucgaaaacgagagaacccuggacuuucaugacuccaaugugaagaaccuuuaugaaaaagucaagagccaacugaagaauaacgccaaagagaucggcaaugggugcuucgaguuuuaccacaaguguaacgaugaaugcauggagucugugaaaaauggcacauaugacuaccccaaguauuccgaagagagcaaacucaaccgggagaagauugauggaguuaagcuggaaucuaugggcguguaccagauccuggcuauuuauuccaccgucgccagcucccucgugcugcuuguuucucugggggccaucagcuucuggaugugcuccaauggaucucuccagugucgcaucugcauuuga

SEQ ID NO: 191068 - RNA, 1698 nt, Artificial Sequence; identical to SEQ ID NO: 191060
  derived and/or modified sequence opt5 from hemagglutinin__InfluenzaA__AEX35065

SEQ ID NO: 191069 - RNA, 1698 nt, Artificial Sequence; identical to SEQ ID NO: 185512
  derived and/or modified sequence opt5 from hemagglutinin__InfluenzaA__AEX35076

SEQ ID NO: 191070 - RNA, 1698 nt, Artificial Sequence
  derived and/or modified sequence opt5 from hemagglutinin__InfluenzaA__AEX35087
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucaagcgguuugaaaucuuccccaaagaguccagcuggccuaaccacacggugaccggaguuucugccuccugcagccauaauggcgagucuuccuuuuauaagaaccugcuuuggcugacaggcaaaaaugggcucuaccccaaccugagcaagucuuaugcuaauaacaaagaaaaggaggugcugguccucuggggagugcaccacccuccgaacaucggcgaucagaugacccuguaccauaaggaaaaugccuacguguccgucguuagcucccacuauucucgcaaauucacacccgagauugcuaagagaccuaaagugcgggaccaggaagggcgcaucaacuacuauuggacccuucuggagcccggagauacgauuaucuuugaggccagcggcaaucucauugcgccuagauacgccuucgcucugucccggggguuuggaagcggcaucauuaacucuaaugcccccauggacgaaugugaugcuaagugccagacaccgcaaggcgccaucaacuccagccuuccuuuccagaaugugcaucccgucaccaucggggaguguccuaaauaugugcgcucugcgaagcugagaaugguuacaggacuccggaacauucccagcauccagucccgcggccuguuuggggccauugcuggauucaucgaaggcggguggaccggaaugguggacggcugguacggcuaucaccaccagaaugagcaagggucuggauacgccgcugaucagaaaagcacccagaacgccauuaauggcaucacaaacaaggucaauuccgugaucgaaaagaugaacacgcaguuuaccgccguugggaaagaguucaauaagcuggagagacggauggaaaaccucaacaaaaagguggacgauggauucauugacgucuggacauacaaugcugagcugcuugugcugcucgaaaacgagcgcacccuggacuuucaugauagcaaugucaaaaaccuuuaugaaaaggugaagaaucaacugaaaaacaaugcgaaggagaucggcaacgggugcuucgaguuuuaccacaaauguaaugacgaaugcauggagucuguuaagaacggcacauaugauuaccccaaauauuccgaagagagcaagcucucuagagagaagauugacggagugaaacuggaauccaugggcgucuaccagauccuggccauuuauagcaccguggcuuccucucucguucugcuugugagccugggggccaucuccuucuggaugugcucuaauggaagccuccagugucggaucugcauuuga

SEQ ID NO: 191071 - RNA, 1698 nt, Artificial Sequence
  derived and/or modified sequence opt5 from hemagglutinin__InfluenzaA__AEX35098
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucauguccucucacuauagcagaaaguucacacccgaaauugccaagcggccuaaaguucgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgugaccaucggggaguguccuaaguaugucagaucugccaaacugcggauggugacaggacuccgcaauauucccagcauccaguccagaggccuguuuggggcuauugccggauucaucgaaggcggguggaccggaaugguugauggcugguacggcuaucaccaccagaacgagcaagggucuggauacgcugccgaccaaaagagcacccagaaugccauuaacggcaucacaaauaaagugaacuccgucaucgaaaagaugaauacgcaguuuaccgcuguggggaaggaguucaacaaacuggagcggcgcauggaaaaccucaauaagaaaguugaugacggauucauugauaucuggacauacaacgcggagcugcuugugcugcucgaaaaugagagaacccuggacuuucaugacagcaacgucaagaaucuuuaugaaaaagugaagucucagcugaagaacaaugccaaagagauuggcaacgggugcuucgaguuuuaccacaaguguaaugaugaaugcauggaguccgucaaaaacggcacauaugacuaccccaaguauagcgaagagucuaaacucaaucgggagaagaucgauggagugaagcuggaauccaugggcguuuaccagauucuggcuaucuauagcaccguggccuccucucucguccugcuugugagccugggggccaucuccuucuggaugugcucuaacggaagccuccagugucgcauuugcaucuga

SEQ ID NO: 191072 - RNA, 1698 nt, Artificial Sequence
  derived and/or modified sequence opt5 from hemagglutinin__InfluenzaA__AEX35109
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccagccuccgaacaucggcgaccagaaagcccuguaccacaccgagaaugcuuacgugagcgucguuuccucucauuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccaaacaccgcagggcgcgaucaauuccagccuuccuuuccagaacgugcaccccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaucaccaaaacgagcaggggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucacgacagcaacgugaagaaucuuuaugaaaaagucaagucucagcugaagaacaaugccaaagagauuggcaacgggugcuucgaguuuuaccauaaguguaaugaugaaugcauggaguccgugaaaaacggcacauaugacuaccccaaguauagcgaagagucuaaacucaaucgggagaagaucgauggaguuaagcuggaauccaugggcguguaccagauucuggcuaucuauagcaccgucgccuccucucucgugcugcuuguuagccugggggccaucuccuucuggaugugcucuaacggaagccuccaaugucgcauuugcaucuga

SEQ ID NO: 191073 - RNA, 1698 nt, Artificial Sequence
  derived and/or modified sequence opt5 from hemagglutinin__InfluenzaA__AEX35120
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgauagagaggggcggaucaacuacuauuggacccuucuggagcccggagacacgauuaucuuugaagcgaauggcaaccucauugccccucgcuacgcuuucgcccuguccagaggguuuggaagcggcaucauuaauucuaacgcucccauggauaagugugacgccaaaugccagacaccgcagggcgcgaucaauuccagccuuccuuuccaaaacgugcaucccgucaccaucggggaguguccuaaguaugugcggucugccaaacugcgcaugguuacaggacucagaaauauucccagcauccagucccggggccuguuuggggcuauugccggauucaucgaaggcggguggaccggaaugguggauggcugguacggcuaucaccaccagaacgagcaggggucuggauacgcugccgaccaaaagagcacccagaaugccauuaacggcaucacaaauaaagucaacuccgugaucgaaaagaugaauacgcaguuuaccgcuguugggaaggaguucaacaaacuggagcgcagaauggaaaaccucaauaagaaaguggaugacggauucauugauaucuggacauacaacgcggagcugcuuguccugcucgaaaaugagcggacccuggacuuucaugacagcaacgugaagaaucuuuaugaaaaagucaagucucagcugaagaacaaugccaaagagauuggcaacgggugcuucgaguuuuaccacaaguguaaugaugaaugcauggaguccgugaaaaacggcacauaugacuaccccaaguauagcgaagagucuaaacucaaucgcgagaagaucgauggaguuaagcuggaauccaugggcguguaccaaauucuggcuaucuauagcaccgucgccuccucucucgugcugcuuguuagccugggggccaucuccuucuggaugugcucuaacggaagccuccaguguagaauuugcaucuga

SEQ ID NO: 191074 - RNA, 1698 nt, Artificial Sequence; identical to SEQ ID NO: 190817
  derived and/or modified sequence opt5 from hemagglutinin__InfluenzaA__AEX35131

SEQ ID NO: 191075 - RNA, 1698 nt, Artificial Sequence; identical to SEQ ID NO: 190817
  derived and/or modified sequence opt5 from hemagglutinin__InfluenzaA__AEX35142

SEQ ID NO: 191076 - RNA, 1698 nt, Artificial Sequence
  derived and/or modified sequence opt5 from hemagglutinin__InfluenzaA__AEX35153
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcaaucagaugacccuguaccauaaggagaacgccuacguguccgucguuagcucccacuauucucgcaaguucacacccgaaauugcuaaaagaccuaaggugcgggaucaggaggggcgcaucaauuacuauuggacccuucuggagcccggagacacgauuaucuuugaagccagcggcaaccucauugcgccuagauacgccuucgcucugucccggggguuuggaagcggcaucauuaauucuaacgcccccauggaugagugugacgcuaaaugccagacaccgcaaggcgccaucaauuccaaccuuccuuuccagaaugugcaucccgucaccaucggggaauguccuaaguaugugcgcagcgcgaaacugagaaugguuacaggacuccggaacauucccucuauccagagccgcggccuguuuggggccauugcuggauucaucgagggcggguggaccggaaugguggauggcugguacggcuaucaccaccagaaugaacaaggguccggauacgccgcugaccagaagucuacccagaacgccauuaauggcaucacaaacaaagucaauagcgugaucgagaagaugaacacgcaguuuaccgccguugggaaggaguucaacaaacuggaaagacggauggagaaucucaacaagaaaguggaugacggauucauugaugucuggacauacaaugcugaacugcuugugcugcucgagaacgaacgcacccuggacuuucaugacuccaaugucaagagccuuuaugagaaagugaagaaccaacugaagaauaacgcgaaagagaucggcaaugggugcuucgaauuuuaccacaaguguaacgaugagugcauggaaucuguuaaaaauggcacauaugacuaccccaaguauuccgaggagagcaaacucucuagagaaaagauugauggagugaagcuggaguccaugggcgucuaccagauccuggccauuuauagcaccguggcuuccucucucguucugcuugugagccugggggccaucuccuucuggaugugcucuaacggaagccuccagugucggaucugcauuuga

SEQ ID NO: 191077 - RNA, 1698 nt, Artificial Sequence
  derived and/or modified sequence opt5 from hemagglutinin__InfluenzaA__AEX35164
augaaggugaaacugcucguccugcuuugcgccuucaccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccggcaaaaaugggcucuaccccaaccugucuaaguccuaugccaauaacaaagagaaggaagugcugguccucuggggagugcaccacccuccgaacaucggcgugcagaaagcucuguaccauacagagaaugccuacgucagcguuguguccucucacuauagcagaaaguucacccccgaaauugcgaagcggccuaaagugcgcgaccaggaggggagaaucaacuacuauuggacacuucuggagcccggagauaccauuaucuuugaagccaauggcaaccucauugcuccucgguacgccuucgcucugucccgcggguuuggaagcggcaucauuaauucuaacgcccccauggacaagugugaugcgaaaugccagacgccgcaaggcgccaucaauuccagccuuccuuuccagaacguccaucccgugacaaucggggaguguccuaaguauguuagaucugcuaaacugcggauggugaccggacuccgcaauauucccagcauccaguccagaggccuguuuggggccauugcuggauucaucgaaggcggguggacaggaauggucgacggcugguacggcuaucaccaccagaacgagcaagggucuggauacgccgccgaucaaaagagcacccagaaugcuauuaacggcaucaccaauaaagugaacuccguuaucgaaaagaugaauacacaguuuacggcgguggggaaggaguucaacaaacuggagcggcgcauggaaaaccucaauaagaaagucgacgauggauucauugacaucuggaccuacaacgccgagcugcuugugcugcucgaaaaugagagaacacuggauuuucaugacagcaacgucaagaaucuuuaugaaaaagugaagucucagcugaagaacaaugcuaaagagauuggcaacgggugcuucgaguuuuaccacaaguguaaugacgaaugcauggaguccguuaaaaacggcaccuaugauuaccccaaguauagcgaagagucuaaacucaaucgggagaagaucgacggagugaagcuggaauccaugggcgucuaccagauucuggccaucuauagcacaguggccuccucucucguucugcuugugagccugggggcuaucuccuucuggaugugcucuaacggaagccuccagugucgcauuugcaucuga

SEQ ID NO: 191078 - RNA, 1698 nt, Artificial Sequence
  derived and/or modified sequence opt5 from hemagglutinin__InfluenzaA__AEX35175
augaaggugaaacugcucguccugcuuugcaccuucacagccacguacgcugacaccaucuguauuggcuaucacgccaacaauagcacagauaccguugacacagugcuggagaagaacgugaccgucacacauuccguggaucuccuggaagacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaccccgaaccccgagaauggcacguguuauccuggguacuuugccgauuaugaggaacugagagagcaacucuccucugucagcuccuucgaacgguuugagaucuuccccaaggagagcucuuggccuaaccauaccgugacaggaguuaccgccuccugcagccacaauggcaagucuuccuuuuaccgcaaccugcuuuggcugacaggcaaaaaugggcucuaucccaaccugagcaagucuuacgcuaauaacaaagaaaaggaggugcugguccucuggggagugcaucacccuccgaauaucggcgaccagagagcccuguaccacaccgaaaacgcuuauguguccgucguuagcucccauuacucucggcgcuucacgcccgagauugccaaaagaccuaaggugcgggaucaggaagggcgcaucaacuauuacuggacacuucuggagcccggagacaccauuaucuuugaggcgaauggcaaccucauugccccuagauucgcuuuugcccugaaucggggguucggaagcggcaucauuacauccaacgcucccauggauggcugugacgccaagugccagaccccgcaaggggcgaucaauagcucucuuccuuuucagaacgugcaccccgucaccaucggagaauguccuaaauaugugcgcuccgccaagcugagaauggcuacaggccuccggaauauucccagcauccagucucgcgggcuguucggagccauugcuggcuuuaucgaagggggauggacgggcaugguugauggcugguacggguaucaucaccagaacgaacaaggaagcggcuacgccgccgaccagaaauccacccagaaugcuauuaacgggaucacaaauaaggugaacucugucaucgagaaaaugaauacccaguucacagcggugggaaaggaguucagcaaacuggagagacggauggagaaccucaauaagaagguugaugacggcuuucuggacauuuggaccuacaacgccgaacuucuggugcuccuggagaacgaacgcacgcuugauuuccacgacuccaaugucaaaaaccuguaugagaaggugaaaagccaacucaagaauaacgcuaaagaaaucgggaauggcugcuuugaguucuaccauaaguguaacgaugagugcauggaaucugucaagaauggaacauaugacuaccccaaauauuccgaggaaagcaagcugaacagagagaaaauugauggcgugaagcuggagucuauggggguuuaccagauccucgccauuuauuccaccguggccagcucccugguccuucuggugucucucggagcuaucagcuuuuggaugugcuccaauggcucucugcagugucggaucugcauuuga

SEQ ID NO: 191079 - RNA, 1698 nt, Artificial Sequence
  derived and/or modified sequence opt5 from hemagglutinin__InfluenzaA__AEX35186
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcaaccagagagcccuguaccauacagagaaugcuuacgugagcguggucuccucucacuauagccggaaauucacccccgaaauugccaagcgcccuaagguuagagaucaggaggggcggaucaacuacuauuggacgcuucuggagcccggagacacaauuaucuuugaagcgaauggcaaccucauugccccucgcuacgcuuucgcccuguccagaggguuuggaagcggcaucauuaauucuaacgcucccauggaugagugugacgccaaaugccagaccccgcaaggcgcgaucaauuccagccuuccuuuccagaacgugcaucccgugacaaucggggaauguccuaaguauguccggucugccaaacugcgcauggugaccggacucagaaauauucccagcauccagucccggggccuguuuggggcuauugccggauucaucgagggcggguggaccggaaugguugauggcugguacggcuaucaccaccagaacgaacaagggucuggauacgcugccgaccaaaagagcacacagaaugccauuaacggcaucacgaauaaagugaacuccgucaucgagaagaugaauacccaguuuacagcuguggggaaagaguucaacaagcuggaacgcagaauggagaaccucaauaagaaaguugaugacggauucauugauaucuggaccuacaacgcggaacugcuugugcugcucgagaaugaacggacacuggacuuucaugacagcaacgucaagaaucuuuaugagaaagugaagucucagcugaaaaacaaugccaaggagauuggcaacgggugcuucgaauuuuaccacaaguguaaugaugagugcauggaauccgucaaaaacggcaccuaugacuaccccaaguauagcgaggagucuaaacucaaucgcgaaaagaucgauggagugaaacuggaguccaugggcguuuaccagauucuggcuaucuauagcacgguggccuccucucucguccugcuugugagccugggggccaucuccuucuggaugugcucuaacggaagccuccaguguagaauuugcaucuga

SEQ ID NO: 191080 - RNA, 1698 nt, Artificial Sequence; identical to SEQ ID NO: 191079
  derived and/or modified sequence opt5 from hemagglutinin__InfluenzaA__AEX35197

SEQ ID NO: 191081 - RNA, 1698 nt, Artificial Sequence; identical to SEQ ID NO: 185512
  derived and/or modified sequence opt5 from hemagglutinin__InfluenzaA__AEX35208

SEQ ID NO: 191082 - RNA, 1701 nt, Artificial Sequence
  derived and/or modified sequence opt5 from hemagglutinin__InfluenzaA__AEX35219
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuuccgggcgcguuaccgugucuacgaagagaagccaacagacagucauuccgaacaucggcucccggcccugggugcgcgaugugagcucuagaauuuccaucuacuggaccauugucaaaccuggggacauccugcucaucaauagcacaggaaaccugauugcuccccggggcuauuucaagauccgcucuggaaagagcuccauuaugagaucugacgccccuaucgggaaauguaauagcgaaugcauuacccccaacggcuccaucccgaaugauaagccuuuucagaacguuaaucggaucaccuacggcgccuguccccgcuaugugaaacagaacacacuuaagcuggcgacggggaugagaaaugugccugagaaacaaacccggggaauuuucggcgccaucgcuggguuuauugaaaacggaugggagggcauggucgacgggugguacggauuccgccaccagaauagcgagggcacaggccaggccgcugaucucaagucuacccaagccgccaucaaccagauuaaugggaaacugaacagacuuaucggaaagacaaaugaaaaguuucaucagaucgagaaagaguucuccgaaguggaaggccggauucaggaccuggagaaguauguugaggauaccaaaaucgaccucuggagcuacaacgcugaacugcugguggcgcucgagaaccaacacacgauugaucugacagacucugaaaugaauaaacuuuucgagagaaccaagaagcagcugcgcgaaaacgccgaggauauggggaauggaugcuuuaagaucuaucauaaaugugacaacgcuugcauuggcuccauccggaaugggaccuacgaucacgacgucuacagagacgaggcccucaacaaucgcuuccagauuaagggcguggaacugaaaagcggauauaaggauuggauccuuuggaucuccuuugccaugucuugcuuccugcucuguguugugcugcugggcuuuauuaugugggcuugccagaaagggaacauccgguguaauauuugcaucuga

SEQ ID NO: 191083 - RNA, 1698 nt, Artificial Sequence; identical to SEQ ID NO: 191024
  derived and/or modified sequence opt5 from hemagglutinin__InfluenzaA__AEX35230

SEQ ID NO: 191084 - RNA, 1701 nt, Artificial Sequence; identical to SEQ ID NO: 184921
  derived and/or modified sequence opt5 from hemagglutinin__InfluenzaA__AEX35241

SEQ ID NO: 191085 - RNA, 1698 nt, Artificial Sequence; identical to SEQ ID NO: 191024
  derived and/or modified sequence opt5 from hemagglutinin__InfluenzaA__AEX35263

SEQ ID NO: 191086 - RNA, 1698 nt, Artificial Sequence; identical to SEQ ID NO: 191024
  derived and/or modified sequence opt5 from hemagglutinin__InfluenzaA__AEX35274

SEQ ID NO: 191087 - RNA, 1701 nt, Artificial Sequence; identical to SEQ ID NO: 184819
  derived and/or modified sequence opt5 from hemagglutinin__InfluenzaA__AEX35285

SEQ ID NO: 191088 - RNA, 1701 nt, Artificial Sequence; identical to SEQ ID NO: 190985
  derived and/or modified sequence opt5 from hemagglutinin__InfluenzaA__AEX35296

SEQ ID NO: 191089 - RNA, 1701 nt, Artificial Sequence
  derived and/or modified sequence opt5 from hemagglutinin__InfluenzaA__AEX35307
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucaacuggaccggcgugacacagaauggcaccuccagcgcuugcaagcgcagaucuaacaaguccuuuuucagccggcuuaauuggcugacacaucucaaauauaaguacccugcccugaacgucaccaugcccaauaacgagaaauuugacaaacuuuauauuuggggagugcaccauccugggacggauucugaccagaucucccuguacgcgcaggccagcggccgcauuacaguuuccaccaagagaucucaacagacagugaucccgaacauugggagccggccccgcgucagagauguguccagccggaucucuaucuacuggaccauugugaagccuggagacauccuccugauuaauuccaccggcaaccugaucgcuccccgcggguauuucaagauuagaagcggaaaaucuagcaucaugcgguccgacgccccuaucggcaaguguaauucugagugcauuacacccaacggcagcaucccgaaugauaaaccuuuucagaacgucaaucgcauuacguacggggcuugucccagauauguuaagcagaacacccucaaacuggccacaggaaugcggaaugugccugaaaagcaaacccgcggcaucuucggggcgauugccggauuuaucgagaacggcugggaagggaugguggacggaugguacggcuucagacaccaaaauuccgagggcacagggcaggcugccgaucuuaaaagcacccaggcugccaucaaccagauuaauggaaagcugaaccggcucaucggcaagacgaaugagaaauuucaccagauugaaaaggaguucucugaagucgaggggagaauccaggaccuggaaaaauauguggaggauacaaagauugaccuuugguccuacaacgccgagcugcucguugcucuggaaaaccaacauaccaucgaucugaccgacagcgagaugaauaaacucuucgaacgcacaaagaagcagcugcgggagaacgcggaagauaugggaaauggcugcuuuaaaauuuaucacaagugugacaacgccugcaucgggucuaucagaaauggcaccuacgaucaugacguguaccgcgacgaggcucuuaacaaucgguuccagauuaaaggagucgagcugaaguccggcuauaaagauuggauccucuggauuagcuuugccaucuccugcuuccugcuuugugugguucugcucggguuuauuaugugggccugccagaagggaaacaucagauguaauaucugcauuuga

SEQ ID NO: 191090 - RNA, 1701 nt, Artificial Sequence; identical to SEQ ID NO: 190985
  derived and/or modified sequence opt5 from hemagglutinin__InfluenzaA__AEX35318

SEQ ID NO: 191091 - RNA, 1701 nt, Artificial Sequence
  derived and/or modified sequence opt5 from hemagglutinin__InfluenzaA__AEX35329
augaagaccaucauugcccugagcuacuuccucugccugguguuugcucagaaacuucccggcaacgacaauuccacagccacgcugugucucgggcaccaugcggucccuaacggaaccaucguuaagacaauuaccaaugaucaaaucgaggugacaaacgcuaccgaacuggugcagaauagcagcacaggcgggauuugcgacuccccgcaccagauccuugauggagagaacuguacccugaucgacgcccuccugggcgauccccagugcgacggguuccaaaauaaaaagugggaucuguuugucgaaagaucuaaagccuauagcaacuguuacccuuaugacgugcccgauuacgcuucccuccggucucugguugccagcuccggaacgcuugaguucaauaacgaaucuuuuaauuggaccggcgugacacagaacggcaccucuuccgcuugcaagcgcagaagcaauaagucuuucuuuucccggcugaacuggcucacacaucugaaauauaaguacccugcccuuaaugucaccaugcccaacaacgagaaauucgacaagcuguauauuuggggagugcaccauccugggacggauagcgaccagaucucucucuacgcgcaggccuccggccgcauuacaguuagcaccaaaagaucccaacagacagugaucccgaauauugggucucggccccgcgucagagaugugagcucccggaucagcauuuacuggaccaucgugaagccuggagacauccugcugauuaacucuaccggcaaucucaucgcuccccgcggguauuuuaagauuagauccggaaaaagcucuaucaugcggagcgacgccccuauuggcaaguguaacuccgagugcaucacacccaauggcucuaucccgaacgauaaaccuuuccagaaugucaaccgcauuacguacggggcuugucccagauauguuaagcagaauacccugaaacuugccacaggaaugcggaacgugccugaaaagcaaacccgcggcaucuuuggggcgauugccggauucaucgagaauggcugggaagggaugguggacggaugguacggcuuuagacaccagaacagcgagggcacagggcaggcugccgaucugaaauccacccaagcugccauuaaucagaucaacggaaagcucaaucggcugaucggcaagacgaacgagaaauuccaccagauugaaaaggaguucagcgaagucgaggggagaauccaggaccuugaaaaauauguggaggauacaaagauugaccuguggucuuacaacgccgagcuccugguugcucuggaaaaucaacauaccaucgaucucaccgacuccgagaugaacaaacuguuugaacgcacaaagaagcagcuucgggagaaugcggaagauaugggaaacggcugcuucaaaauuuaucacaagugugacaaugccugcaucgggagcauuagaaacggcaccuacgaucaugacguguaccgcgacgaggcucugaauaaccgguuucagaucaaaggagucgagcucaagucuggcuauaaagauuggauccuguggauuuccuucgccaucagcugcuuucuucuguguguggcccuccugggguucauuaugugggcuugccagaagggaaauaucagauguaacauuugcaucuga

SEQ ID NO: 191092 - RNA, 1701 nt, Artificial Sequence
  derived and/or modified sequence opt5 from hemagglutinin__InfluenzaA__AEX35340
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgggaucugcgacuccccgcaccagauccuugauggagagaacuguacccugauugacgcccuccugggcgauccccagugcgacggguuucagaauaaaaagugggaucuguucgucgaaagaucuaaagccuauagcaacuguuacccuuaugacgugcccgauuacgcuucccuccggucucugguugccagcuccggaacgcuugaguuuaauaacgaaucuuucaauuggaccggcgugacacagaacggcaccucuuccgcuugcaagcgcagaagcaauaagagcuuuuucucccggcugaacuggcucacacaucugaaauauaaguacccugcccuuaaugucaccaugcccaacaacgagaaauuugacaagcuguauaucuggggagugcaccauccugggacggauagcgaccagauuucucucuacgcgcaggccuccggccgcaucacaguuagcaccaaaagaucccaacagacagugauuccgaauaucgggucucggccccgcgucagagaugugagcucccggauuagcaucuacuggaccaucgugaagccuggagacauucugcugaucaacucuaccggcaaucucauugcuccccgcggguauuucaagaucagauccggaaaaagcucuauuaugcggagcgacgccccuaucggcaaguguaacuccgagugcaucacacccaauggcucuauuccgaacgauaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggacggaugguacggcuucagacaccagaacagcgagggcacagggcaggcugccgaucugaaauccacccaagcugccaucaaucagaucaacggaaagcucaaucggcugauuggcaagacgaacgagaaauuucaccagaucgaaaaggaguucagcgaagucgaggggcgcauucaggaccuugaaaaauauguggaggauacaaagaucgaccuguggucuuacaacgccgagcuccugguugcucuggaaaaucaacauaccauugaucucaccgacuccgagaugaacaaacuguucgaaagaacaaagaagcagcuucgggagaaugcggaagauaugggaaacggcugcuuuaaaaucuaucacaagugugacaaugccugcauugggagcaucagaaacggcaccuacgaucaugacguguaccgcgacgaggcucugaauaaccgguuccagaucaaaggagucgagcucaagucuggcuauaaagauuggauucuguggaucuccuuugccauuagcugcuuccuucuguguguggcccuccugggguuuaucaugugggcuugccagaagggaaauauuagauguaacaucugcaucuga

SEQ ID NO: 191093 - RNA, 1701 nt, Artificial Sequence; identical to SEQ ID NO: 190985
  derived and/or modified sequence opt5 from hemagglutinin__InfluenzaA__AEX35351

SEQ ID NO: 191094 - RNA, 1701 nt, Artificial Sequence; identical to SEQ ID NO: 190985
  derived and/or modified sequence opt5 from hemagglutinin__InfluenzaA__AEX35362

SEQ ID NO: 191095 - RNA, 1701 nt, Artificial Sequence; identical to SEQ ID NO: 184819
  derived and/or modified sequence opt5 from hemagglutinin__InfluenzaA__AEX35373

SEQ ID NO: 191096 - RNA, 1701 nt, Artificial Sequence
  derived and/or modified sequence opt5 from hemagglutinin__InfluenzaA__AEX35384
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuucugucaccaugcccaacaaugagaaauucgacaagcuguacaucuggggagugcaccauccugggacggauaacgaccagauuucccucuaugcgcaggccagcggccgcaucacaguuuccaccaaaagaucucaacagacagugauuccgaacaucgggagccggacccgcgucagagaugugcccucccggauuagcaucuacuggaccaucgugaagccuggagacauucugcugaucaauucuacaggcaaccucauugcuccccgcggguacuuuaagaucagauccggaaaaagcucuauuaugcggagcgacgccccuaucggcaaguguaauuccgagugcaucacgcccaacggcucuauuccgaaugauaaaccuuuccagaacgucaaucgcaucaccuauggggcuugucccagauacguuaagcagaacacacugaaacuugccaccggaaugcggaaugugccugaaaagcaaacacgcggcauuuuuggggcgaucgccggauucauugagaacggcugggaagggaugguggacggaugguauggcuuuagacaccagaauagcgagggcaccgggcaggcugccgaucugaaauccacgcaagcugccaucaaccagaucaauggaaagcucaaccggcugauuggcaagacaaaugagaaauuccaccagaucgaaaaggaguucagcgaagucgaggggcgcauucaggaccuugaaaaauacguggaggauaccaagaucgaccuguggucuuauaacgccgagcuccugguugcucuggaaaaccaacauaccauugaucucacagacuccgagaugaauaaacuguuugaaagaaccaagaagcagcuucgggagaacgcggaagauaugggaaauggcugcuucaaaaucuaccacaagugugacaacgccugcauugggagcaucagaaauggcacauaugaucaugacguguaccgcgacgaggcucugaacaaucgguuucagaucaaaggagucgagcucaagucuggcuacaaagauuggauucuguggaucuccuucgccauuagcugcuuucuucuguguguggcccuccugggguucaucaugugggcuugccagaagggaaacauuagauguaauaucugcaucuga

SEQ ID NO: 191097 - RNA, 1701 nt, Artificial Sequence
  derived and/or modified sequence opt5 from hemagglutinin__InfluenzaA__AEX35395
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaaguggaaucuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcaagcgcagaucuaauaaguccuuuuucagccggcugaacuggcucacacaucugaaauuuaaguauccugcccuuaaugucaccaugcccaacaacgagaaauucgauaagcuguacaucuggggcgugcaccauccugggacggacaaugaucagauuucucucuaugcgcaggccuccggacgcaucacaguuagcaccaaaagaucccaacagacagugauuccgaacaucggcucucggccccgcgucagagacgugccuagccggauuuccaucuacuggaccaucgugaagcccggggauauucugcugaucaauagcaccggaaaccucauugcuccucgcggcuacuuuaagaucagaucugggaaauccagcauuaugcggucugacgcccccaucggaaaguguaauagcgaaugcaucacaccgaacggcuccauuccuaaugacaaacccuuccagaacgucaaucgcaucacguauggcgcuuguccuagauacguuaagcagaacacccugaaacuugccacagggaugcggaaugugcccgagaagcaaacccgcggaauuuuuggcgcgaucgccggguucauugaaaacggaugggagggcaugguggaugggugguauggauuuagacaccaaaauucugagggcacaggccaggcugccgaccugaaaagcacccaggcugccaucaaccagaucaaugggaagcucaaccggcugauuggaaagacgaacgaaaaauuccaccagaucgagaaggaguucuccgaagucgaaggccgcauucaggaucuugagaaauacguggaggacacaaagaucgaucuguggagcuauaaugccgaacuccugguugcucuggagaaccaacauaccauugaccucaccgauucugaaaugaauaaacuguuugagagaacaaagaagcagcuucgggaaaacgcggaggacauggggaauggaugcuucaaaaucuaccacaagugugauaacgccugcauuggcuccaucagaaaugggaccuaugaccaugauguguaccgcgacgaggcucugaacaaucgguuucagaucaaaggcgucgaacucaagagcggauacaaagacuggauucuguggaucucuuucgccauuuccugcuuucuucuguguguggcccuccugggcuucaucaugugggcuugccagaaggggaacauuagauguaauaucugcaucuga

SEQ ID NO: 191098 - RNA, 1701 nt, Artificial Sequence; identical to SEQ ID NO: 184819
  derived and/or modified sequence opt5 from hemagglutinin__InfluenzaA__AEX35406

SEQ ID NO: 191099 - RNA, 1701 nt, Artificial Sequence; identical to SEQ ID NO: 184819
  derived and/or modified sequence opt5 from hemagglutinin__InfluenzaA__AEX35417

SEQ ID NO: 191100 - RNA, 1701 nt, Artificial Sequence
  derived and/or modified sequence opt5 from hemagglutinin__InfluenzaA__AEX35428
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaaaagugggaucucuucgucgaaagaagcaaagccuauuccaauuguuacccuuaugacgugcccgauuacgcuucucugcggagccuuguugccuccagcggaacgcuggaguuuaacaaugaaucuuucaacuggaccggcguggcucaaaauggcacauccagcgccugcaagcgcagaucugacaaguccuuuuucagccggcucaacuggcugcaccagcuuaaauauaaguacccugcgcugaaugucaccaugcccaacaaugagaaauuugauaagcucuauauuuggggagugcaucacccugggacagacucugaucagaucucccuguacgcccaggcuagcggccgcauuaccguuuccacgaaaagaucucaacagacagugaucccgaacauugggagccggccccgcgucagagacguguccagccggaucucuauuuacuggaccaucgugaagccuggagacauccuguucauuaacuccacaggcaaucucaucgcuccccgcggguauuuuaagauuagaagcggaaaaucuagcaucaugcgguccgaugccccuauugacaaguguaacucugagugcaucacccccaauggcagcaucccgaacgauaaaccuuuccagaaugucaaccgcauuaccuacggcgccugucccagauauguuaagcagaauacacugaaacuugcgacggggaugcggaacgugccugaaaagcaaacccgcggaaucuuuggcgccauugcuggguucaucgagaauggaugggaaggcaugguggacgggugguacggauuuagacaccagaacuccgagggcacaggccaggccgcugaucugaaaagcacccaagccgccauuaaucagaucaacgggaagcucaaucggcugaucggaaagacaaacgagaaauuccaucagauugaaaaggaguucucugaagucgagggcagaauccaggaccuugaaaaauauguggaggauaccaagauugaccugugguccuacaaugcugagcuccugguugcgcuggaaaaccaacacacgaucgaucucacagacagcgagaugaacaaacuguuugaacgcaccaagaagcagcuucgggagaaugccgaagauauggggaacggaugcuucaaaauuuaucauaagugugacaaugcuugcaucggcucuauuagaaacgggaccuacgaccacgauguguaccgcgacgaggcccugaauaaccgguuucagaucaaaggcgucgagcucaaguccggauauaaagauuggauccuguggauuagcuucgccaucuccugcuuucuucuguguguggcucuccugggcuucauuaugugggccugccagaaggggaauaucagauguaacauuugcaucuga

SEQ ID NO: 191101 - RNA, 1698 nt, Artificial Sequence
  derived and/or modified sequence opt5 from hemagglutinin__InfluenzaA__AEX35439
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaaugguuaccggacuccggaauauucccagcauccagucccgcggccuguucggggcuauugccggauuuaucgaaggcggguggacaggaaugguggacggcugguacggcuaucaucaccagaacgagcaagggucuggauacgcugccgaucagaaaagcacgcagaaugccauuaacggcaucaccaauaaggucaacuccgugaucgaaaagaugaauacacaguucaccgcuguugggaaagaguucaacaaacuggagagacggauggaaaaucucaacaagaagguggacgauggauuucuggacauuuggacauacaacgcggagcuucugguccuccuggaaaaugagcgcacccuugacuuccacgauagcaacgugaaaaaucuguaugaaaaggucaaaucucaacucaagaacaaugccaaagagaucggcaacgggugcuuugaguucuaccauaaguguaaugacgaaugcauggaguccgugaagaacggcacguaugauuaccccaaauauagcgaagagucuaagcugaauagagagaaaauugacggaguuaagcuggaauccaugggcguguaccagauccucgcuauuuauagcacagucgccuccucucuggugcuucugguuagccucggggccaucuccuuuuggaugugcucuaacggaagccugcagugucggaucugcauuuga

SEQ ID NO: 191102 - RNA, 1701 nt, Artificial Sequence
  derived and/or modified sequence opt5 from hemagglutinin__InfluenzaA__AEX35450
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaaacuucaauuggaccggcgugacacagaacggcaccucuuccgcuugcaagcgcagaagcaauaacuccuuuuucucucggcugaauuggcucacacaucugaaguuuaaauauccugcccuuaacgucaccaugcccaacaaugagaaguucgacaaacuguacaucuggggagugcaccauccugggacggauaacgaccagauuuuucucuaugcgcaggccagcggccgcaucacaguuucuaccaagagaucccaacagacagugauuccgaauaucgggagccggccccgcgucagaaacauuccuucccggaucucuaucuacuggaccauugugaaacccggagauauccugcugauuaauagcaccggcaaccucaucgcuccucgcggguacuucaagauucaguccggaaagagcucuaucaugagauccgacgcccccaucggcaaauguaauagcgagugcauuacaccgaacggcucuaucccuaaugacaagcccuuucagaacgugaaucggauuacguauggggcuuguccucgcuacgucaaacaaaacacccugaaacuugccacaggaaugagaaauguucccgaaaagcagacccggggcaucuucggggcgauugccggauuuaucgagaacggcugggaagggaugguggauggaugguauggcuuccgccaccagaauagcgagggcaucgggcaagcugccgaccugaaguccacacaggcugccauuaaccagaucaacggaaaacucaauagacugauuggcaagaccaacgagaaguuccaccagaucgaaaaagaguuuucugaaguggaggggcggauucaagaucuugaaaaguacgucgaggacacgaaaaucgaucuguggagcuauaaugccgagcuccugguggcucuggaaaaccagcauacaauugaccucaccgauuccgagaugaauaagcuguucgaaagaaccaaaaagcagcuucgcgagaacgcggaagacaugggaaauggcugcuuuaagaucuaccacaaaugugauaacgccugcaucgggagcauucggaauggcacauaugaccaugauguuuacagagacgaggcucugaacaaucgcuuccagaucaagggaguggagcucaaaucuggcuacaaggacuggauucuguggaucuccuuugccauuagcugcuuccuucugugugucgcccuccugggguuuaucaugugggcuugccaaaaaggaaacauccgguguaauauuugcaucuga

SEQ ID NO: 191103 - RNA, 1701 nt, Artificial Sequence; identical to SEQ ID NO: 183654
  derived and/or modified sequence opt5 from hemagglutinin__InfluenzaA__AEX35461

SEQ ID NO: 191104 - RNA, 1701 nt, Artificial Sequence
  derived and/or modified sequence opt5 from hemagglutinin__InfluenzaA__AEX35472
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgauuuucaaaacaaaaagugggaccuguucgucgaaagaagcaaagccuauuccaauuguuacccuuaugaugugcccgacuacgcuucucuccggagccugguugccuccagcgggacgcuugaguuuaacaaugaaucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgauaaacuguacaucuggggcgugcaccauccugggacggacaaugaucagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggacauccugcugauuaacuccaccggaaaucucaucgcuccucgcggcuacuucaagauuagaagcgggaagucuuccaucaugcggagcgacgcccccaucggaaaauguaacucugagugcauuacaccgaauggcagcaucccuaacgauaagcccuuucagaaugugaaccgcauuacguauggcgcuuguccuagauacgucaaacagaauacccugaaacuugccacagggaugcggaacguucccgaaaagcaaacccgcggaaucuucggcgcgauugccggguuuaucgagaauggaugggaaggcaugguggacgggugguauggauucagacaccagaacuccgagggcaucggccaggcugccgaucugaagucuacacaagcugccauuaaucagaucaacgggaaacucaaccggcugauuggaaagaccaaugagaaguuccaccagaucgaaaaagaguuuagcgaaguggagggccgcauucaggaccuugaaaaguacgucgaggauacgaaaaucgaccugugguccuauaacgccgagcuccugguggcucuggaaaaucaacauacaauugaucucaccgacagcgagaugaacaagcuguucgaaagaaccaaaaagcagcuucgggagaaugcggaagauauggggaacggaugcuuuaagaucuaccacaaaugugacaaugccugcaucggcucuauuagaaacgggacauaugaucaugacguuuaccgcgacgaggcucugaauaaccgguuccagaucaagggcguggagcucaaauccggauacaaggauuggauucuguggaucagcuuugccauuucuugcuuccuucugugugucgugcuccugggcuuuaucaugugggccugccagaaagggaauaucagauguaacauuugcaucuga

SEQ ID NO: 191105 - RNA, 1701 nt, Artificial Sequence; identical to SEQ ID NO: 183654
  derived and/or modified sequence opt5 from hemagglutinin__InfluenzaA__AEX35483

SEQ ID NO: 191106 - RNA, 1701 nt, Artificial Sequence
  derived and/or modified sequence opt5 from hemagglutinin__InfluenzaA__AEX35494
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgggcugcaaaacaaaaagugggaucucuuugucgaaagaagcaaagccuauuccaauuguuacccuuaugacgugcccgauuacgcuucucugcggagccuuguugccuccagcggaacgcuggaguucaacaaugaaucuuuuaacuggaccggcgugacacagaauggcaccuccagcgcuugcaagcgcagaucuaacaauuccuucuuuagccggcucaacuggcugacacaucuuaaguucaaauauccugcccugaaugucaccaugcccaacaacgagaaguuugacaaacucuacaucuggggagugcaccauccugggacggauaaugaccagauuuuccuguaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcucauuaacuccaccggcaaucugaucgcuccucgcggguacuuuaagauuagaagcggaaagucuuccaucaugcggagcgacgcccccaucggcaaauguaacucugagugcauuacaccgaauggcagcaucccuaacgacaagcccuuccagaaugugaaccgcauuacguauggggcuuguccuagauacgucaaacagaauacccuuaagcuggccacaggaaugcggaacguucccgaaaaacaaacccgcggcaucuuuggggcgauugccggauucaucgagaauggcugggaagggaugauggauggaugguauggcuuuagacaccagaacuccgagggcaucgggcaggcugccgaccucaagucuacacaagcugccauuaaucagaucaacggaaaacugaaccggcuuauuggcaagaccaaugagaaguuccaccagaucgaaaaagaguucagcgaaguggaggggcgcauucaggaucuggaaaaguacguggaggacacgaaaaucgaucucugguccuauaacgccgagcugcuggucgcucucgaaaaucaacauacaauugaccugaccgauagcgagaugaacaaacuuuuugaaagaaccaagaagcagcugcgggagaaugcggaagacaugggaaacggcugcuucaagaucuaccacaaaugugauaaugccugcaucgggucuauuagaaacggcacauaugaccaugauguguaccgcgacgaggcucucaauaaccgguuucagaucaagggaguugagcugaaauccggcuacaaggacuggauucuuuggaucagcuucgccauuucuugcuuucugcucuguguggcccugcugggguucaucaugugggcuugccagaaaggaaauaucagauguaacauuugcaucuga

SEQ ID NO: 191107 - RNA, 1701 nt, Artificial Sequence
  derived and/or modified sequence opt5 from hemagglutinin__InfluenzaA__AEX35505
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgauuuucaaaacaaaaagugggaccuguucgucgaaagaagcaaagccuauuccaauuguuacccuuaugaugugcccgacuacgcuucucuccggagccugguugccuccagcgggacgcuugaguuuaacaaugaaucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgauaaacuguacaucuggggcgugcaccauccugggacggacaaugaucagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggacauccugcugauuaacuccaccggaaaucucaucgcuccucgcggcuacuucaagauucugagcgggaagucuuccaucaugagaagcgacgcccccaucggaaaauguaacucugagugcauuacaccgaauggcagcaucccuaacgauaagcccuuucagaaugugaaccggauuacguauggcgcuuguccucgcuacgucaaacagaauacccuuaagcuggccacagggaugagaaacguucccgaaaaacaaacccggggaaucuucggcgcgauugccggguuuaucgagaauggaugggaaggcaugguggacgggugguauggauuccgccaccagaacuccgagggcaucggccaggcugccgaucucaagucuacacaagcugccauuaaucagaucaacgggaaacugaacagacuuauuggaaagaccaaugagaaguuccaccagaucgaaaaagaguuuagcgaaguggagggccggauucaggaccuggaaaaguacgucgaggauacgaaaaucgaccucugguccuauaacgccgagcugcugguggcucucgaaaaucaacauacaauugaucugaccgacagcgagaugaacaaacuuuucgaaagaaccaagaagcagcugcgcgagaaugcggaagauauggggaacggaugcuuuaagaucuaccacaaaugugacaaugccugcaucggcucuauucggaacgggacauaugaucaugacguuuacagagacgaggcucucaauaaccgcuuccagaucaagggcguggagcugaaauccggauacaaggauuggauucuuuggaucagcuuugccauuucuugcuuccugcucugugucgcccugcugggcuuuaucaugugggcuugccagaaagggaauauccgguguaacauuugcaucuga

SEQ ID NO: 191108 - RNA, 1701 nt, Artificial Sequence
  derived and/or modified sequence opt5 from hemagglutinin__InfluenzaA__AEX35516
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgggcugcaaaacaaaaagugggaucucuuugucgaaagaagcaaagccuauuccaauuguuacccuuaugacgugcccgauuacgcuucucugcggagccuuguugccuccagcggaacgcuggaguucaacaaugaaucuuuuaacuggaccggcgugacacagaauggcaccuccagcgcuugcaagcgcagaucuaacaauuccuucuuuagccggcucaacuggcugacacaucuuaaguucaaauauccugcccugaaugucaccaugcccaacaacgagaaguuugacaaacucuacaucuggggagugcaccauccugggacggauaaugaccagauuuuccuguaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcucauuaacuccaccggcaaucugaucgcuccucgcggguacuuuaagauuagaagcggaaagucuuccaucaugcggagcgacgcccccaucggcaaauguaacucugagugcauuacaccgaauggcagcaucccuaacgacaagcccuuccagaaugugaaccgcauuacguauggggcuuguccuagauacgucaaacagaauacccuuaagcuggccacaggaaugcggaacguucccgaaaaacaaacccgcggcaucuuuggggcgauugccggauucaucgagaauggcugggaagggaugguggauggaugguauggcuuuagacaccagaacuccgagggcaucgggcaggcugccgaccucaagucuacacaagcugccauuaaucagaucaacggaaaacugaaccggcuuauuggcaagaccaaugagaaguuccaccagaucgaaaaagaguucagcgaaguggaggggcgcauucaggaucuggaaaaguacgucgaggacacgaaaaucgaucucugguccuauaacgccgagcugcugguggcucucgaaaaucaacauacaauugaccugaccgauagcgagaugaacaaacuuuuugaaagaaccaagaagcagcugcgggagaaugcggaagacaugggaaacggcugcuucaagaucuaccacaaaugugauaaugccugcaucgggucuauuagaaacggcacauaugaccaugauguuuaccgcgacgaggcucucaauaaccgguuucagaucaagggaguggagcugaaauccggcuacaaggacuggauucuuuggaucagcuucgccauuucuugcuuucugcucugugucgcccugcugggguucaucaugugggcuugccagaaaggaaauaucagauguaacauuugcaucuga

SEQ ID NO: 191109 - RNA, 1701 nt, Artificial Sequence
  derived and/or modified sequence opt5 from hemagglutinin__InfluenzaA__AEX35527
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaucugaaguuuaaauauccugcucuuaaugugaccaugcccaacaacgagcaguucgacaagcuguacaucuggggaguucaccauccugggacggauaaugaccagauuucucucuaugcccaagcguccggccgcaucacagugagcaccaaaagaucccagcagacagucauuccgaacaucgggucucggccccgcgugagagauauuccuagccggaucuccaucuacuggaccauugugaagcccggagacauccugcugauuaauagcaccggcaaccucaucgccccucgcggguacuuuaaaauuagaucuggaaaguccagcaucaugcggucugacgcucccaucggcaaguguaauagcgagugcauuacaccgaacggcuccaucccuaaugauaaacccuuccagaacgucaaucgcauuacguauggggccuguccuagauacguuaagcaaaacacccugaaacuugcuacaggaaugcggaaugugcccgaaaagcagacccgcggcaucuuuggggccauugcgggauucaucgagaacggcugggaagggaugguggacggaugguauggcuuuagacaccaaaauucugagggcaucgggcaggccgcugaucugaaaagcacacaggccgcuauuaaccagaucaauggaaagcucaaccggcugauuggcaaaaccaacgagaaguuccaccagaucgaaaaggaguucuccgaagucgaggggcgcauucaagaccuugaaaaauacguggaggauacgaagaucgaccuguggagcuauaaugccgagcuccugguugcccuggaaaaccagcauacaauugaucucaccgacucugagaugaauaaacuguuugaaagaaccaagaaacagcuucgggagaacgcugaagauaugggaaauggcugcuucaagaucuaccacaagugugacaacgcgugcaucggguccauuagaaauggcacauaugaucaugacguguaccgcgacgaggcccugaacaaucgguuucagaucaaaggagucgagcucaagagcggcuacaaagauuggauucuguggaucucuuucgcuauuuccugcuuucuucuguguguggcccuccugggguucaucaugugggccugccaaaagggaaacaucagauguaauauuugcaucuga

SEQ ID NO: 191110 - RNA, 1701 nt, Artificial Sequence
  derived and/or modified sequence opt5 from hemagglutinin__InfluenzaA__AEX35549
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcgggucuaacaauuccuuuuucagcagacugaacuggcucacacaucugaaguuuaaauauccugcccuuaaugugaccaugcccaacaacgaggaguucgacaagcuguacauuuggggaguccaccauccuggcacggauaaugaccagaucucucucuaugcgcaggccuccgggaaaauuacagugagcaccaagcggucccaacagacaguuaucccgaacauuggaucucgccccagagugcgggauaucccuagccgcaucuccauuuacuggaccaucgucaaacccggcgacauucugcugaucaauagcaccgggaaccucauugcuccuagaggauacuuuaagauccggucuggcaaguccagcaucaugcgcucugacgcccccauugauaaauguaauagcgaaugcaucacaccgaacggcuccauuccuaaugacaagcccuuccagaacgugaauaaaaucacguauggggcuuguccuagauacgugaagcagaacacccugaaacuugccacaggaaugcggaauguccccgagaagcaaacccgcggcauuuuuggggcgaucgccggauucaucgaaaacggcugggaggggaugguugauggaugguauggcuuuagacaccaaaauucugagggcauugggcaggcugccgaccugaaaagcacacaggcugccaucgaucagauuaacggaaagcucaaucggcugaucggcaagaccaacgaaaaauuccaccagauugagaaggaguucuccgaaguggaagggcgcauccaggaccuugagaaauacguggaggauacgaagauugaccuguggagcuauaacgccgaacuccuggucgcucuggagaaucaacauacaaucgaucucaccgacucugaaaugaacaaacuguuugagagaaccaagaagcagcuucgggaaaaugcggaggauaugggaaacggcugcuucaaaaucuaccacaagugugacaaugccugcauuggguccaucagaaacggcacauaugaccaugauguguaccgcgacgaggcucugaauaaccgguuucagauuaaaggaguugaacucaagagcggcuacaaagauuggauccuguggauuucuuucgccaucuccugcuuucuucuguguguggcccuccugggguucaucaugugggcuugccagaagggaaauauuagauguaacaucugcauuuga

SEQ ID NO: 191111 - RNA, 1701 nt, Artificial Sequence
  derived and/or modified sequence opt5 from hemagglutinin__InfluenzaA__AEX35560
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaucugaaguuuaaauauccugcucuuaaugugaccaugcccaacaacgagcaguucgacaagcuguacaucuggggaguucaccauccugggacggauaaugaccagauuucucucuaugcccaagcguccggccgcaucacagugagcaccaaaagaucccagcagacagucauuccgaacaucgggucucggccccgcgugagagauauuccuagccggaucuccaucuacuggaccauugugaagcccggagacauccugcugauuaauagcaccggcaaccucaucgccccucgcggguacuuuaaaauuagaucuggaaaguccagcaucaugcggucugacgcucccaucggcaaguguaauagcgagugcauuacaccgaacggcuccaucccuaaugauaaacccuuccagaacgucaaucgcauuacguauggggccuguccuagauacguuaagcaaaacacccugaaacuugcuacaggaaugcggaaugugcccgaaaagcagacccgcggcaucuuuggggccauugcgggauucaucgagaacggcugggaagggaugguggacggaugguauggcuuuagacaccaaaauucugucggcaucgggcaggccgcugaucugaaaagcacacaggccgcuauuaaccagaucaauggaaagcucaaccggcugauuggcaaaaccaacgagaaguuccaccagaucgagaaggaguucuccgaaguggaagggcgcauucaagaccuugagaaauacguugaagauacgaagaucgaccuguggagcuauaaugccgagcuccugguggcccuggagaaccagcauacaauugaucucaccgacucugaaaugaauaaacuguuugagagaaccaagaaacagcuucgggaaaacgcugaggauaugggaaauggcugcuucaagaucuaccacaagugugacaacgcgugcaucggguccauuagaaauggcacauaugaucaugacgucuaccgcgacgaagcccugaacaaucgguuucagaucaaaggaguggagcucaagagcggcuacaaagauuggauucuguggaucucuuucgcuauuuccugcuuucuucuguguguugcccuccugggguucaucaugugggccugccaaaagggaaacaucagauguaauauuugcaucuga

SEQ ID NO: 191112 - RNA, 1701 nt, Artificial Sequence
  derived and/or modified sequence opt5 from hemagglutinin__InfluenzaA__AEX35571
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagccgggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggagugcaccauccugggacggauaaugaccagauuuuucucuaugcgcaggccucuggcagaaucacaguuuccaccaaacggagccaacagacagugauuccgaacaucgggucccgccccagaguccggaauauuccuucucgcaucagcaucuacuggaccauugugaagcccggagauauccugcugauuaacuccaccggcaaucucaucgcuccuagaggguacuucaaaauucggagcggaaagucuuccaucaugcgcagcgacgcccccaucggcaaguguaacucugagugcauuacaccgaauggcagcaucccuaacgacaaacccuuucagaaugugaacagaauuacguauggggcuuguccucgguacgucaagcagaauacccugaaacuugccacaggaaugcgcaacguucccgaaaagcaaaccagaggcaucuucggggcgauugccggauuuaucgagaauggcugggaagggaugguggauggaugguauggcuuccggcaccagaacuccgagggcaucgggcaggcugccgaccugaaaucuacacaagcugccauuaaucagaucaacggaaagcucaacagacugauuggcaaaaccaaugagaaguuccaccagaucgaaaaggaguuuagcgaaguggaggggcgcauucaggaucuugaaaaauacgucgaggacacgaagaucgaucugugguccuauaacgccgagcuccugguggcucuggaaaaucaacauacaauugaccucaccgauagcgagaugaacaaacuguucgaacggaccaagaaacagcuuagagagaaugcggaagacaugggaaacggcugcuuuaagaucuaccacaagugugauaaugccugcaucgggucuauucgcaacggcacauaugaccaugauguuuaccgggacgaggcucugaauaacagauuccagaucaaaggaguggagcucaaguccggcuacaaagacuggauucuguggaucagcuuugccauuucuugcuuccuucugugugucgcccuccugggguuuaucaugugggcuugccagaagggaaauauccgcuguaacauuugcaucuga

SEQ ID NO: 191113 - RNA, 1701 nt, Artificial Sequence; identical to SEQ ID NO: 183654
  derived and/or modified sequence opt5 from hemagglutinin__InfluenzaA__AEX35582

SEQ ID NO: 191114 - RNA, 1701 nt, Artificial Sequence
  derived and/or modified sequence opt5 from hemagglutinin__InfluenzaA__AEX35593
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcuccccugggcaaauguaacucugagugcaucacaccgaauggcagcauuccuaacgacaagcccuuucagaaugugaaccgcaucacguauggggccuguccuagauacgucaaacagaauacccuuaagcuggccacaggaaugcggaacguucccgaaaaacaaacccgcggcauuuucggggcgaucgccggauuuauugagaauggcugggaagggaugguggauggaugguauggcuucagacaccagaacuccgagggcaucgggcaggcugccgaccucaagucuacacaagcugccaucaaucagauuaacggaaaacugaaccggcuuaucggcaagaccaaugagaaguuccaccagauugaaaaagaguuuagcgaaguggaggggagaauccaggaucuggaaaaguacgucgaggacacgaaaauugaucucugguccuauaacgccgagcugcugguggcucucgaaaaucaacauacaaucgaccugaccgauagcgagaugaacaaacuuuucgaacgcaccaagaagcagcugcgggagaaugcggaagacaugggaaacggcugcuuuaagauuuaccacaaaugugauaaugccugcaucgggucuaucagaaacggcacauaugaccaugauguuuaccgcgacgaggcucucaauaaccgguuccagauuaagggaguggagcugaaauccggcuacaaggacuggauccuuuggauuagcuuugccaucucuugcuuccugcucugugucgcccugcugggguuuauuaugugggcuugccagaaaggaaauaucagauguaacaucugcauuuga

SEQ ID NO: 191115 - RNA, 1701 nt, Artificial Sequence; identical to SEQ ID NO: 185396
  derived and/or modified sequence opt5 from hemagglutinin__InfluenzaA__AEX35604

SEQ ID NO: 191116 - RNA, 1701 nt, Artificial Sequence
  derived and/or modified sequence opt5 from hemagglutinin__InfluenzaA__AEX35615
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacauugaggauacgaagaucgaccugugguccuauaaugccgaacuccuggucgcucuggagaaccaacauacaaucgaucucaccgacagcgaaaugaauaaacuguucgagaagaccaaaaagcagcuucgcgaaaacgcggaggauauggggaauggaugcuuuaagauuuaccacaaaugugacaacgccugcaucggcucuauucggaaugggacauaugaucaugacguguacagagacgaggcucugaacaaucgcuuccagaucaagggcguugaacucaaauccggauacaaggauuggauucuguggaucagcuuugccaucucuugcuuccuucuguguguggcccuccugggcuuuauuaugugggcuugccagaaagggaacauccgguguaauauuugcaucuga

SEQ ID NO: 191117 - RNA, 1701 nt, Artificial Sequence; identical to SEQ ID NO: 185458
  derived and/or modified sequence opt5 from hemagglutinin__InfluenzaA__AEX35626

SEQ ID NO: 191118 - RNA, 1701 nt, Artificial Sequence
  derived and/or modified sequence opt5 from hemagglutinin__InfluenzaA__AEX35637
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcgggucugacaacuccuuuuucagcaagcugaauuggcucacacaucugaaauuuaaguauccugcccuuaacgucaccaugcccaauaacgagaaauucgauaagcuguacaucuggggagugcaccauccuggcacggacaacgaucagauuuuuccguaugcgcaggccucugggagaaucacaguuuccaccaaacggagccaacagacagugauucccaauaucggaucccgcccuagaguccggaacauucccucucgcaucagcaucuacuggaccauugugaagccuggcgacauccuccugauuaauuccaccgggaaccugaucgcucccagaggauacuucaagauucggagcggcaaaucuuccaucaugcgcagcgacgccccgaucggcaaguguaauucugagugcauuacaccuaacgggagcauccccaaugauaaaccuuuucagaacgugaauagaauuacguauggagcuuguccccgguacgucaagcagaacacccucaaacuggccacaggcaugcgcaauguucccgaaaagcaaaccagagggaucuucggagcgauugccggcuuuaucgagaacgggugggaaggaaugguggacggcugguauggcuuccggcaccaaaauuccgaggggaucggacaggcugccgaucuuaaaucuacacaggcugccauuaaccagaucaauggcaagcugaaccgccucauugggaagaccaacgagaaauuccaccagaucgaaaaggaguuuagcgaaguggagggacggauucaggaccuggaaaaauacgucgaggauacgaagaucgaccuuugguccuauaaugccgagcugcucguggcucuggaaaaccaacauacaauugaucugaccgacagcgagaugaauaaacucuucgaaagaaccaagaagcagcugagagagaacgcggaagauaugggcaaugggugcuuuaaaaucuaccacaagugugacaacgccugcaucggcucuauucgcaauggaacauaugaucaugacguuuaccgggacgaggcucuuaacaauagauuccagaucaaaggcguggagcugaaguccggguacaaagauuggauucucuggaucagcuuugccauuucuugcuuccugcuuugugucgcccugcucggauuuaucaugugggcuugccagaagggcaacauccgcuguaauauuugcaucuga

SEQ ID NO: 191119 - RNA, 1701 nt, Artificial Sequence; identical to SEQ ID NO: 185458
  derived and/or modified sequence opt5 from hemagglutinin__InfluenzaA__AEX35648

SEQ ID NO: 191120 - RNA, 1701 nt, Artificial Sequence
  derived and/or modified sequence opt5 from hemagglutinin__InfluenzaA__AEX36102
augaagaccaucauugcccugagcuacauccucugccugguguucgcucagaaacuucccggcaacaauaacuccacagccacgcugugucucgggcaccaugcggucccuaauggaaccauuguuaagacaaucaccaacgaccaaauugaggugacaaaugcuaccgaacuggugcagucuagcuccacaggcgagaucugcgauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguauccugcccuuaacgucaccaugcccaacaaugagaaauucgauaagcuguacauuuggggcgugcaccauccugggacggacaacgaucagaucuuucucuaugcgcaggccucuggacgcauuacaguuuccaccaaaagaagccaacagacagugaucccgaauauuggcucccggccccgcgucagaaacaucccuucucggaucagcauuuacuggaccaucgugaagcccggggacauucugcugaucaauuccaccggaaaccucauugcuccucgcggcuacuucaaaaucagaagcgggaagucuuccaucaugcggagcgaugcccccauuggaaaguguaauucugaaugcaucacaccgaacggcagcauuccuaaugacaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggacgggugguauggauucagacaccaaaauuccgagggcauuggccaggcugccgaucugaaaucuacacaggcugccaucgaccagauuaacgggaagcucaaccggcugaucggaaaaaccaaugaaaaguuccaccagauugagaaggaauuuagcgagguggaaggcagaauccaggaucuugagaaauacgucgaggacacgaagauugaucugugguccuauaacgccgaacuccugguggcucuggagaaucaacauacaaucgaccucaccgauagcgaaaugaacaaacuguucgagaagaccaaaaagcagcuucgcgaaaaugcggaggacauggggaacggaugcuuuaagaucuaccacaaaugugauaaugccugcauuggcucuauccggaacgggacauaugaccaugauguuuacagagacgaggcucugaauaaccgcuuccagauuaagggcguggaacucaaauccggauacaaggacuggauccuguggauuagcuuugccaucucuugcuuccuucugugugucgcccuccugggcuuuaucaugugggcuugccagaaagggaauauucgguguaacaucugcauuuga

SEQ ID NO: 191121 - RNA, 1701 nt, Artificial Sequence; identical to SEQ ID NO: 184939
  derived and/or modified sequence opt5 from hemagglutinin__InfluenzaA__AEX36113

SEQ ID NO: 191122 - RNA, 1701 nt, Artificial Sequence; identical to SEQ ID NO: 185458
  derived and/or modified sequence opt5 from hemagglutinin__InfluenzaA__AEX36124

SEQ ID NO: 191123 - RNA, 1701 nt, Artificial Sequence
  derived and/or modified sequence opt5 from hemagglutinin__InfluenzaA__AEX36146
augaagaccaucauugcccugagcuacauccucugccuggugcuugcucagaaacugcccggcgacgauaacuccacagccacgcucugucuggggcaccaugcggucccuaauggaaccauuguuaagacaaucaccaacgaccaaauugaggugacaaaugcuaccgaacuugugcagucuagcuccacaggcgagaucugcgauucuccgcaccagauccuggacggggaaaacuguacccucauugaugcccugcugggagacccccagugcgauggcuuccaaaauaaaaagugggaccucuuugucgagagaagcaaagccuauuccaacuguuacccuuaugaugugcccgacuacgcuucucugcggagccuuguugccuccagcgggacgcuggaguucaauaacgaaucuuuuaauuggaccggagugacacagaacggcaccuccagcgcuugcauccgcagaucuaauaacuccuucuuuagccggcucaauuggcugacacaucuuaaguucaaguauccugcccugaacgucaccaugcccaauaacgagcaguuugauaaacucuacauuuggggcgugcaccauccugggacggacaacgaucagaucuuccuguaugcgcaagccucuggacgcauuacaguuuccaccaagagaagccagcagacagugaucccgaauauuggcucccggccccgcgucagaaacaucccuucucggaucagcauuuacuggaccaucgugaaacccggggacauucugcucaucaauuccaccggaaaccugauugcuccucgcggcuacuuuaagaucagaagcgggaaaucuuccaucaugcggagcgacgcccccauuggaaaguguaauucugaaugcaucacaccgaacggcagcauuccuaaugauaagcccuuccagaacgugaaucgcaucacguauggcgcuuguccuagauacgucaaacaaaacacccuuaagcuggccacagggaugcggaauguucccgagaaacagacccgcggaauuuuuggcgcgaucgccggguucaucgaaaacggaugggagggcaugguggacgggugguauggauuuagacaccaaaauuccgagggccggggccaggcugccgaucucaagucuacacaggcugccauugaccagaucaacgggaaacugaauagacuuauuggaaagaccaacgaaaaauuccaccagaucgagaaggaguucagcgaaguggaaggccgcauucaagaucuggagaaguacgucgaggacacgaaaaucgaucucugguccuauaacgccgaacugcugguggcucucgagaaucagcauacaauugaccugaccgauagcgaaaugaacaaacuuuuugagaagaccaagaaacagcugcgggaaaaugcggaggacauggggaacggaugcuucaagaucuaccacaagugugauaaugccugcaucggcucuauuagaaacgggacauaugaccaugacguuuaccgcgaugaggcucucaauaaccgguuucagaucaaaggcguggaacugaaguccggauacaaagacuggauucuuuggaucagcuucgccauuucuugcuuucugcucugugucgcccugcugggcuucaucaugugggcuugccaaaaggggaauaucagauguaacauuugcaucuga

SEQ ID NO: 191124 - RNA, 1701 nt, Artificial Sequence
  derived and/or modified sequence opt5 from hemagglutinin__InfluenzaA__AEX36168
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauugggcuggcgugacccagaacggcacauccagcgccugcaagcgcgggucugacaauuccuuuuucagcagacugaacuggcucacccaucugaaguuuaaauauccugcgcuuaaugucacaaugcccaacaaugaggaguucgauaagcuguacauuuggggagugcaccauccuggcaccgacaacgaucagaucuuucucuaugcccaggcuucugggcggauuacgguuuccacaaaacgcagccaacagaccgugaucccgaacauuggauccagaccccggguccgcaauaucccuucuagaaucagcauuuacuggacaaucgugaagcccggcgacauucugcugaucaacuccaccgggaaucucauugccccucggggauacuucaaaauccgcagcggcaagucuuccaucaugagaagcgacgcucccauuggcaaguguaacucugaaugcaucaccccgaaugggagcauuccuaacgauaaacccuuucagaaugugaaccggaucacauauggagccuguccucgcuacgucaagcagaauacgcugaaacuugcgaccggcaugagaaacguucccgagaagcaaacacgggggauuuucggagccaucgcuggcuuuaucgaaaaugggugggagggaaugguggacggcugguauggcuuccgccaccagaacuccgaggggauuggacaggccgcugaucugaaaucuacccaagccgccaucgaccagauuaauggcaagcucaacaaacugaucgggaagacaaaugaaaaguuccaccagauugagaaagaauuuagcgagguggaaggaagaauccaggaucuugagaaguacgucgaggacaccaaaauugaucugugguccuauaacgcugaacuccugguggcgcuggagaaccaacauacgaucgaccucacagauagcgaaaugaauaagcuguucgagaaaaccaagaagcagcuucgggaaaacgccgaggacaugggcaaugggugcuuuaaaaucuaccacaagugugauaacgcuugcauuggcucuaucagaaauggaaccuaugaccaugacguuuaccgcgaugaggcccugaacaaucgguucaaaauuaagggcguggaacucaaauccggguacaaggacuggauccuguggauuagcuuugccaucucuugcuuccuucugugugucgcucuccugggauuuaucaugugggccugccagaagggcaacauuaaauguaauaucugcauuuga

SEQ ID NO: 191125 - RNA, 1701 nt, Artificial Sequence; identical to SEQ ID NO: 185458
  derived and/or modified sequence opt5 from hemagglutinin__InfluenzaA__AEX36179

SEQ ID NO: 191126 - RNA, 1701 nt, Artificial Sequence; identical to SEQ ID NO: 191007
  derived and/or modified sequence opt5 from hemagglutinin__InfluenzaA__AEX36190

SEQ ID NO: 191127 - RNA, 1701 nt, Artificial Sequence; identical to SEQ ID NO: 191002
  derived and/or modified sequence opt5 from hemagglutinin__InfluenzaA__AEX36201

SEQ ID NO: 191128 - RNA, 1701 nt, Artificial Sequence
  derived and/or modified sequence opt5 from hemagglutinin__InfluenzaA__AEX36212
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucuguaugcgcaggccucugggcggauuacaguuuccaccaagaucagccaacagacagugauuccgaacaucggaucccgccccagaguccggaauaucccuucucgcauuagcaucuacuggaccauugugaagcccggcgauauccuccugauuaacuccaccgggaaucugaucgcuccuagaggauacuucaaaauccggagcggcaagucuuccauuaugcgcagcgacgcccccaucggcaaguguaacucugaaugcauuacaccgaaugggagcaucccuaacgacaaacccuuucagaaugugaacagaauuacguauggagcuuguccucgguacgucaagcagaauacccucaaacuggccacaggcaugcgcaacguucccgagaagcaaaccagagggaucuucggagcgaucgccggcuuuauugaaaaugggugggagggaaugguggauggcugguauggcuuccggcaccagaacuccgaggggaucggacaggcugccgaccuuaaaucuacacaagcugccauugaucagaucaauggcaagcugaaccgccucauugggaaaaccaacgaaaaguuccaccagaucgagaaggaauuuagcgagguggaaggacggauucaggaccuggagaaauacgucgaggauacgaagaucgaccuuugguccuauaaugccgaacugcucguggcucuggagaaccaacauacaaucgaucugaccgacagcgaaaugaauaaacucuucgagaagaccaaaaagcagcugagagaaaacgcggaggauaugggcaaugggugcuuuaagauuuaccacaaaugugacaacgccugcaucggcucuauuagaaauggaacauaugaucaugacguuuaccgcgacgaggcucuuaacaaucgguuccagaucaagggcguggaacugaaauccggguacaaggauuggauucucuggaucagcuuugccaucucuugcuuccugcuuugugucgcccugcucggauuuauuaugugggcuugccagaaaggcaacaucagauguaauauuugcaucuga

SEQ ID NO: 191129 - RNA, 1701 nt, Artificial Sequence; identical to SEQ ID NO: 191002
  derived and/or modified sequence opt5 from hemagglutinin__InfluenzaA__AEX36223

SEQ ID NO: 191130 - RNA, 1701 nt, Artificial Sequence
  derived and/or modified sequence opt5 from hemagglutinin__InfluenzaA__AEX36234
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcgggucugacaacuccuuuuucagcaagcugaauuggcucacacaucugaaauuuaaguauccugcccuuaacgucaccaugcccaauaacgagaaauucgauaagcuguacaucuggggagugcaccauccuggcacggacaacgaucagauuuuucucuaugcgcaggccucugggagaaucacaguuuccaccaaacggagccaacagacagugauuccgaauaucggaucccgccccagaguccggaacauuccuucucgcaucagcaucuacuggaccauugugaagcccggcgacauccugcugauuaauuccaccgggaaccucaucgcuccuagaggauacuucaagauucggagcggcaaaucuuccaucaugcgcagcgacgcccccaucggcaaguguaauucugagugcauuacaccgaacgggagcaucccuaaugauaaacccuuucagaacgugaauagaauuacguauggagcuuguccucgguacgucaagcagaacacccugaaacuugccacaggcaugcgcaauguucccgaaaagcaaaccagagggaucuucggagcgauugccggcuuuaucgagaacgggugggaaggaaugguggacggcugguauggcuuccggcaccaaaauuccgaggggaucggacaggcugccgaucugaaaucuacacaggcugccauuaaccagaucaauggcaagcucaaccgccugauugggaagaccaacgagaaauuccaccagaucgaaaaggaguuuagcgaaguggagggacggauucaggaccuugaaaaauacgucgaggauacgaagaucgaccugugguccuauaaugccgagcuccugguggcucuggaaaaccaacauacaauugaucucaccgacagcgagaugaauaaacuguucgaaagaaccaagaagcagcuuagagagaacgcggaagauaugggcaaugggugccugaaaaucuaccacaagugugacaacgccugcaucggcucuauucgcaauggaacauaugaucaugacguuuaccgggacgaggcucucaacaauagauuucagaucaaaggcguggagcugaaguccggguacaaagauuggauucuuuggaucagcuucgccauuucuugcuuucugcucugugucgcccugcugggauucaucaugugggcuugccagaagggcaacauccgcuguaauauuugcaucuga

SEQ ID NO: 191131 - RNA, 1701 nt, Artificial Sequence
  derived and/or modified sequence opt5 from hemagglutinin__InfluenzaA__AEX36245
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaaacguauagcaauuguuacccuuaugacgugcccgauuacgccucccuccggucucugguugcuagcuccggaacccuugaguuuaacaaugaaucuuucaacuggacaggcgugacccagaauggcacaucuuccgccugcaagcgcgggagcaacaauagcuuuuucuccagacugaacuggcucacccauagcaaguuuaaauauccugcucugaaugucacgaugcccaacaacgaggaguucgacaaacuuuacauuuggggagugcaccauccuggcacagauaaugaccagaucuuucuguaugcccaggcgucugggcggauuaccguuuccacaaaacgcagccaacagaccgugaucccgaacauuggauccagaccccggguccgcaauaucccuucuagaaucagcauuuacuggaccaucgugaagcccggcgauauucuccugaucaacuccacagggaaucugauugccccucggggauacuucaaaauccgcagcggcaagucuuccaucaugagaagcgacgcucccauuggcaaguguaacucugaaugcaucacgccgaaugggagcauuccuaacgacaaacccuuucagaaugugaaccggaucaccuauggagccuguccucgcuacgucaagcagaauacacucaaacuggcuaccggcaugagaaacguucccgagaagcaaacacgggggauuuucggagccaucgcgggcuuuaucgaaaaugggugggagggaaugguggauggcugguauggcuuccgccaccagaacuccgaggggauuggacaggccgcugaccuuaaaucuacccaagccgcuaucgaucagauuaauggcaagcugaacagacucaucgggaaaacgaacgaaaaguuccaccagauugagaaggaauuuagcgagguggaaggacggauccaggaccuggagaaauacgucgaggauacaaagauugaccuuugguccuauaaugccgaacugcucguggcccuggagaaccaacauaccaucgaucugaccgacagcgaaaugaauaaacucuucgagaagacaaagaagcagcugagagaaaacgcugaggauaugggcaaugggugcuuuaagaucuaccacaaaugugacaacgcgugcauuggcucuauccgcaauggaaccuaugaucaugacguuuaccgggacgaggcccuuaacaauagauuccagauuaagggcguggaacugaaauccggguacaaggauuggauccucuggauuagcuuugcuaucucuugcuuccugcuuugugucgcccugcucggauuuaucaugugggccugccagaaaggcaacauucgcuguaauaucugcauuuga

SEQ ID NO: 191132 - RNA, 1701 nt, Artificial Sequence
  derived and/or modified sequence opt5 from hemagglutinin__InfluenzaA__AEX36256
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcaagucuaacaauuccuuuuucagcagacugaacuggcucacccaucugaaguuuaaauauccugcucuuaaugucacgaugcccaacaacgagcaguucgacaagcuguacauuuggggcgugcaccauccugggacagauaaugaccagaucuuucucuaugcccaagcgucuggacggauuaccguuuccacaaaacgcagccagcagaccgugaucccgaacauuggcuccagaccccggguccgcaauaucccuucuagaaucagcauuuacuggaccaucgugaagcccggggauauucugcugaucaacuccacaggaaaucucauugccccucggggcuacuucaaaauccgcagcgggaagucuuccaucaugagaagcgacgcucccauuggaaaguguaacucugaaugcaucacgccgaauggcagcauuccuaacgacaaacccuuucagaaugugaaccggaucaccuauggcgccuguccucgcuacgucaagcaaaauacacugaaacuugcuaccgggaugagaaacguucccgagaagcagacacggggaauuuucggcgccaucgcgggguuuaucgaaaauggaugggagggcaugguggaugggugguauggauuccgccaccagaacuccgagggcagaggccaagccgcugaccugaaaucuacccaggccgcuauugaucagaucaaugggaagcucaaccggcugauuggaaaaacgaacgaaaaguuccaccagaucgagaaggaauuuagcgagguggaaggccgcauucaagaccuugagaaauacgucgaggauacaaagaucgaccugugguccuauaaugccgaacuccugguggcccuggagaaccagcauaccauugaucucaccgacagcgaaaugaauaaacuguucgagaagaccaaaaagcagcuuagagaaaacgcugaggauauggggaauggaugcuuuaagaucuaccacaaaugugacaacgcgugcaucggcucuauucggaaugggacauaugaucaugacguuuacagagacgaggcccugaacaaucgcuuccagaucaagggcguggaacucaaauccggauacaaggauuggauucuguggaucagcuuugcuauuucuugcuuccuucugugugucgcccuccugggcuuuaucaugugggccugccaaaaagggaacauccgguguaauauuugcaucuga

SEQ ID NO: 191133 - RNA, 1701 nt, Artificial Sequence; identical to SEQ ID NO: 191002
  derived and/or modified sequence opt5 from hemagglutinin__InfluenzaA__AEX36267

SEQ ID NO: 191134 - RNA, 1701 nt, Artificial Sequence
  derived and/or modified sequence opt5 from hemagglutinin__InfluenzaA__AEX36289
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucuguaugcgcaggccucugggcggauuacaguuuccaccaagaucagccaacagacagugauuccgaacaucggaucccgccccagaguccggaauaucccuucucgcauuagcaucuacuggaccauugugaagcccggcgauauccuccugauuaacuccaccgggaaucugaucgcuccuagaggauacuucaaaauccggagcggcaagucuuccauuaugcgcagcgacgcccccaucggcaaguguaacucugaaugcauuacaccgaaugggagcaucccuaacgacaaacccuuucagaaugugaacagaauuacguauggagcuuguccucgguacgucaagcagaauacccucaaacuggccacaggcaugcgcaacguucccgagaagcaaaccagagggaucuucggagcgaucgccggcuuuauugaaaaugggugggagggaaugguggauggcugguauggcuaccggcaccagaacuccgaggggaucggacaggcugccgaccuuaaaucuacacaagcugccauugaucagaucaauggcaagcugaaccgccucauugggaaaaccaacgaaaaguuccaccagaucgagaaggaguucagcgaaguggaaggacggauucaggaccuggagaaauaugucgaggauacgaagaucgaccuuugguccuacaaugccgaacugcucguggcucuggagaaccaacauacaaucgaucugaccgacagcgaaaugaauaaacucuuugagaagaccaaaaagcagcugagagaaaacgcggaggauaugggcaaugggugcuucaagauuuaucacaaaugugacaacgccugcaucggcucuauuagaaauggaacauacgaucaugacguuuaccgcgacgaggcucuuaacaaucgguuucagaucaagggcguggaacugaaacucggguauaaggauuggauucuguggaucuccuucgccaucagcugcuuucuucugugugucgcccuccugggauucauuaugugggcuugccagaaaggcaacaucagauguaauauuugcaucuga

SEQ ID NO: 191135 - RNA, 1701 nt, Artificial Sequence
  derived and/or modified sequence opt5 from hemagglutinin__InfluenzaA__AEX36300
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuagcaacgaaucuuucaauuggaccggcgugacacagaacggcaccuccagcgcuugcaagcgcgggucuaauaacuccuuuuucagcaagcugaauuggcucacacauucuaaauuuaaguauccugcccugaacgucaccaugcccaauaacgaggaguucgacaaacuuuacauuuggggagugcaccauccuggcacggauaacgaccagaucuuucuguaugcgcaggccuccgggagaauuacaguuagcaccaagcggucccaacagacagugaucccgaauauuggaucucgccccagaguccggaacaucccuagccgcaucuccauuuacuggaccaucgugaaacccggcgauauucuccugaucaauagcaccgggaaccugauugcuccuagaggauacuucaagauccggucuggcaaguccagcaucaugcgcucugacgcccccauuggcaaauguaauagcgaaugcaucacaccgaacggguccauuccuaaugacaagcccuuucagaacgugaauagaaucacguauggagcuuguccucgguacgucaaacagaacacccucaagcuggccacaggcaugcgcaauguucccgagaaacaaaccagagggauuuucggagcgaucgccggcuuuaucgaaaacgggugggagggaaugguggauggcugguauggcuuccggcaccaaaauucugaggggauuggacaggcugccgaccuuaagagcacacaggcugccaucgaucagauuaacggcaaacugaaucgccucaucgggaagaccaacgaaaaguuccaccagauugagaaagaauuuuccgagguggaaggaagaauccaggaccuggagaaguacgucgaggauacgaaaauugaccuuuggagcuauaacgccgaacugcucguggcucuggagaaucaacauacaaucgaucugaccgacucugaaaugaacaagcuguucgagaaaaccaagaagcagcugcgggaaaaugcggaggauaugggcaacgggugcuuuaaaaucuaccacaagugugacaaugccugcauuggcuccaucagaaacggaacauaugaucaugacguuuaccgcgacgaggcucuuaauaaccgguuccagauuaaaggcguggaacucaagagcggguacaaagauuggauccucuggauuucuuuugccaucuccugcuuccugcuuugugucgcccugcucggauuuaucaugugggcuugccagaagggcaauauuagauguaacaucugcauuuga

SEQ ID NO: 191136 - RNA, 1701 nt, Artificial Sequence
  derived and/or modified sequence opt5 from hemagglutinin__InfluenzaA__AEX36311
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauugggcuggcgugacccagaacggcacauccagcgccugcaagcgcgggucuaauaacuccuuuuucagcagacugaauuggcucacccaucugaaguuuaaauauccugcgcuuaacgucacaaugcccaauaacgaggaguucgacaagcuguacauuuggggagugcaccauccuggcaccgauaacgaccagaucuuucucuaugcccaggcuucugggcggauuacgguuuccacaaaacgcagccaacagaccgugaucccgaauauuggauccagaccccggguccgcaacaucccuucuagaaucagcauuuacuggacaaucgugaagcccggcgauauucugcugaucaauuccaccgggaaccucauugccccucggggauacuucaaaauccgcagcggcaagucuuccaucaugagaagcgacgcucccauuggcaaguguaauucugaaugcaucaccccgaacgggagcauuccuaaugacaaacccuuucagaacgugaaucggaucacauauggagccuguccucgcuacgucaagcagaacacgcugaaacuugcgaccggcaugagaaauguucccgagaagcaaacacgggggauuuucggagccaucgcuggcuuuaucgaaaacgggugggagggaaugguggauggcugguauggcuuccgccaccaaaauuccgaggggauuggacaggccgcugaccugaaaucuacccaggccgccaucgaucagauuaacggcaagcucaauagacugaucgggaaaacaaacgaaaaguuccaccagauugagaaggaauuuagcgagguggaaggacggauccaggaccuugagaaauacgucgaggauaccaagauugaccugugguccuauaacgcugaacuccugguggcgcuggagaaucaacauacgaucgaucucacagacagcgaaaugaacaaacuguucgagaagaccaaaaagcagcuuagagaaaaugccgaggauaugggcaacgggugcuuuaagaucuaccacaaaugugacaaugcuugcauuggcucuauccgcaacggaaccuaugaucaugacguuuaccgggacgaggcccugaauaacagauuccagauuaagggcguggaacucaaauccggguacaaggauuggauccuguggauuagcuuugccaucucuugcuuccuucugugugucgcucuccugggauuuaucaugugggccugccagaaaggcaauauucgcuguaacaucugcauuuga

SEQ ID NO: 191137 - RNA, 1701 nt, Artificial Sequence
  derived and/or modified sequence opt5 from hemagglutinin__InfluenzaA__AEX36322
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuuccguaugcgcaggccucugggcggauuacaguuuccaccaagaucagccaacagacagugauucccaacaucggaucccgcccuagaguccggaauauccccucucgcauuagcaucuacuggaccauugugaagccuggcgauauccugcucauuaacuccaccgggaaucugaucgcucccagaggauacuucaaaauccggagcggcaagucuuccauuaugcgcagcgacgccccgaucggcaaguguaacucugaaugcauuacaccuaaugggagcauccccaacgacaaaccuuuucagaaugugaacagaauuacguauggagcuuguccccgguacgucaagcagaauacccugaaacucgccacaggcaugcgcaacguucccgagaagcaaaccagagggaucuucggagcgaucgccggcuuuauugaaaaugggugggagggaaugguggauggcugguauggcuuccggcaccagaacuccgaggggaucggacaggcugccgaccugaaaucuacacaagcugccauugaucagaucaauggcaaacuuaaccgccugauugggaagaccaacgaaaaguuccaccagaucgagaaggaauuuagcgagguggaaggacggauucaggaccucgagaaauacgucgaggauacgaagaucgaccugugguccuauaaugccgaacuucugguggcucucgagaaccaacauacaaucgaucugaccgacagcgaaaugaauaaacuguucgagaagaccaaaaagcagcucagagaaaacgcggaggauaugggcaaugggugcuuuaagauuuaccacaaaugugacaacgccugcaucggcucuauuagaaauggaacauaugaucaugacguuuaccgcgacgaggcucugaacaaucgguuccagaucaagggcguggaacuuaaauccggguacaaggauuggauucuguggaucagcuuugccaucucuugcuuccuccuguguauugcccuucugggauuuaucaugugggcuugccagaaaggcaacauuagauguaauaucugcauuuga

SEQ ID NO: 191138 - RNA, 1701 nt, Artificial Sequence
  derived and/or modified sequence opt5 from hemagglutinin__InfluenzaA__AEX36333
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucuguaugcgcaggccucugggcggauuacaguuuccaccaagcgcagccaacagacagugaucccgaacauuggauccagaccccggguccgcaauaucccuucuagaaucagcauuuacuggaccaucgugaagcccggcgauauucuccugaucaacuccaccgggaaucugauugcuccucggggauacuucaaaauccgcagcggcaagucuuccaucaugagaagcgacgcccccauuggcaaguguaacucugaaugcaucacaccgaaugggagcauuccuaacgacaaacccuuucagaaugugaaccggaucacguauggagcuuguccucgcuacgucaagcagaauacccucaaacuggccacaggcaugagaaacguucccgagaagcaaacccgggggauuuucggagcgaucgccggcuuuaucgaaaaugggugggagggaaugguggauggcugguauggcuuccgccaccagaacuccgaggggauuggacaggcugccgaccuuaaaucuacacaagcugccaucgaucagauuaauggcaagcugaacagacucaucgggaaaaccaacgaaaaguuccaccagauugagaaggaauuuagcgagguggaaggacggauccaggaccuggagaaauacgucgaggauacgaagauugaccuuugguccuauaaugccgaacugcucguggcucuggagaaccaacauacaaucgaucugaccgacagcgaaaugaauaaacucuucgagaagaccaaaaagcagcugagagaaaacgcggaggauaugggcaaugggugcuuuaagaucuaccacaaaugugacaacgccugcauuggcucuauccgcaauggaacauaugaucaugacgcuuaccgggacgaggcccuuaacaauagauuccagauuaagggcguugaacugaaauccggguacaaggauuggauccucuggauuagcuuugccaucucuugcuuccugcuuuguguggcucugcucggauuuaucaugugggccugccagaaaggcaacauucgcuguaauaucugcauuuga

SEQ ID NO: 191139 - RNA, 1701 nt, Artificial Sequence
  derived and/or modified sequence opt5 from hemagglutinin__InfluenzaA__AEX36344
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaacgccuauuccaauuguuacccuuaugacgugcccgauuacgcuucucuccggagccugguugccuccagcggaacgcuugaguuuaacaaugaaucuuucaacugggcuggcgugacccagaauggcacauccagcgccugcaaacgcgggucuaacaauuccuuuuucagcagacugaacuggcucacccaucugaaguuuaaguauccugcgcuuaaugucacaaugcccaacaacgaggaguucgacaaacuguacauuuggggagugcaccauccuggcaccgauaaugaccagaucuuucucuaugcccaggcuucugggcggauuacgguuuccacaaagcgcagccaacagaccgugaucccgaacauuggauccagaccccggguccgcaauaucccuucuagaaucagcauuuacuggacaaucgugaaacccggcgauauucugcugaucaacuccaccgggaaucucauugccccucggggauacuucaagauccgcagcggcaaaucuuccaucaugagaagcgacgcucccauuggcaaguguaacucugaaugcaucaccccgaaugggagcauuccuaacgacaagcccuuucagaaugugaaccggaucacauauggagccuguccucgcuacgucaaacagaauacgcugaaacuugcgaccggcaugagaaacguucccgagaagcaaacacgggggauuuucggagccaucgcuggcuuuaucgaaaaugggugggagggaaugguggauggcugguauggcuuccgccaccagaacuccgaggggauuggacaggccgcugaccugaagucuacccaagccgccaucgaucagauuaauggcaaacucaacagacugaucgggaagacaaacgaaaaauuccaccagauugagaaggaauuuagcgagguggaaggacggauccaggaccuugagaaguacgucgaggauaccaaaauugaccugugguccuauaaugcugaacuccugguggcgcuggagaaccaacauacgaucgaucucacagacagcgaaaugaauaagcuguucgagaaaaccaagaaacagcuuagagaaaacgccgaggauaugggcaaugggugcuuuaagaucuaccacaagugugacaacgcuugcauugagucuauccgcaauggcaccuaugaucaugacguuuaccgggacgaagcccugaacaauagauuccagauuaaaggaguggagcucaaguccggcuacaaagauuggauccuguggauuagcuuugccaucucuugcuuccuucugugugucgcucuccugggguuuaucaugugggccugccagaagggaaacauucgcuguaauaucugcauuuga

SEQ ID NO: 191140 - RNA, 1701 nt, Artificial Sequence
  derived and/or modified sequence opt5 from hemagglutinin__InfluenzaA__AEX36366
augaagaccaucauugcccugagcuacauccucugccugguguucgcucagaaacuuuccggcaacgacaauucuacagccacgcugugucucgggcaccaugcgguccccaacggaaccauuguuaagacaaucaccaaugaucaaauugaggugacaaacgcuaccgaacuggugcagagcuccucuacaggcgagaucugcgacagcccucaccagauccuugauggggaaaauuguacccugauugacgcccuccugggagauccgcagugcgacggcuuucaaaacaaaaagugggaucuguucgucgagagauccaaagccuauucuaauuguuaccccuaugacgugccugauuacgcuagccuccggucccugguugccagcucugggacgcuugaauuuaacaaugaguccuucaacuggaccggagugacacagaauggcaccagcucugcuugcauccgcagauccaacaauagcuuuuucucucggcugaacuggcucacacaucugaaguuuaaguaucccgcccuuaaugucaccaugccuaacaacgagaaauucgacaagcuguacauuuggggcgugcaccaucccgggacggauaaugaccagaucuuucucuaugcgcaggccuccggacgcauuacaguuagcaccaaaagaucccaacagacagugaucccuaacauuggcucucggccgcgcgucagaaauauccccagccggaucuccauuuacuggaccaucgugaagccuggggauauucugcugaucaacagcaccggaaaucucauugcuccccgcggcuacuucaaaaucagaucugggaaguccagcaucaugcggucugacgccccuauuggaaaguguaacagcgaaugcaucacacccaauggcuccauuccgaacgacaaaccuuuucagaaugugaaccgcaucacguauggcgcuugucccagauacgucaagcagaauacccugaaacuugccacagggaugcggaacguuccugagaagcaaacccgcggaauuuucggcgcgaucgccggguuuaucgaaaauggaugggagggcaugguggaugggugguauggauucagacaccagaacucugagggcauuggccaggcugccgaccugaaaagcacacaagcugccaucgaucagauuaaugggaagcucaaccggcugaucggaaaaaccaacgaaaaguuccaccagauugagaaggaauuuuccgagguggaaggcagaauccaggaccuugagaaauacgucgaggauacgaagauugaccuguggagcuauaaugccgaacuccugguggcucuggagaaccaacauacaaucgaucucaccgacucugaaaugaauaaacuguucgagaagaccaaaaagcagcuucgcgaaaacgcggaggauauggggaauggaugcuuuaagaucuaccacaaaugugacaacgccugcauuggcuccauccggaaugggacauaugaucaugacguuuacagagacgaggcucugaacaaucgcuuccagauuaagggcguggaacucaaaagcggauacaaggauuggauccuguggauuucuuuugccaucuccugcuuccuucugugugucgcccuccugggcuuuaucaugugggcuugccagaaagggaacauucgguguaauaucugcauuuga

SEQ ID NO: 191141 - RNA, 1701 nt, Artificial Sequence; identical to SEQ ID NO: 184952
  derived and/or modified sequence opt5 from hemagglutinin__InfluenzaA__AEX36377

SEQ ID NO: 191142 - RNA, 1701 nt, Artificial Sequence
  derived and/or modified sequence opt5 from hemagglutinin__InfluenzaA__AEX36388
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugauggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacguggaggauacgaagauugaccugugguccuauaaugccgaacuccuggucgcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguguacagagacgaggcucugaacaaucgcuuccagauuaagggcguugaacucaaauccggauacaaggauuggauccuguggauuagcuuugccaucucuugcuuccuucuguguguggcccuccugggcuuuaucaugugggcuugccagaaagggaacauucgguguaauaucugcauuuga

SEQ ID NO: 191143 - RNA, 1701 nt, Artificial Sequence
  derived and/or modified sequence opt5 from hemagglutinin__InfluenzaA__AEX36399
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaacagaggugaccaacgcuacagaacuggugcagucuagcuccaccggcgagauuugcgacucuccgcaccagauccuugauggggaaaauuguacgcugaucgacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacaggagugacccagaauggcacauccagcgcuugcauucgcagaucuaacaauuccuuuuucagccggcugaacuggcucacccaucugaaguuuaaguauccugcccuuaaugucacgaugcccaacaacgagaaauucgacaagcuguacaucuggggcgugcaccauccugggacagauaaugaccagauuuuucucuaugcgcaggccucuggacgcaucaccguuuccacaaaaagaagccaacagaccgugauuccgaacaucggcucccggccccgcgucagaaauauuccuucucggaucagcaucuacuggaccauugugaagcccggggauauccugcugauuaacuccacaggaaaucucaucgcuccucgcggcuacuucaaaauuagaagcgggaagucuuccaucaugcggagcgacgcccccaucggaaaguguaacucugaaugcauuacgccgaauggcagcaucccuaacgacaaacccuuucagaaugugaaccgcauuaccuauggcgcuuguccuagauacgucaagcagaauacacugaaacuugccaccgggaugcggaacguucccgagaagcaaacacgcggaaucuucggcgcgauugccggguuuaucgaaaauggaugggagggcaugguggaugggugguauggauucagacaccagaacuccgagggcaucggccaggcugccgaccugaaaucuacccaagcugccauugaucagaucaaugggaagcucaaccggcugauuggaaaaacgaacgaaaaguuccaccagaucgagaaggaauuuagcgagguggaaggccgcauucaggaccuugagaaauacgucgaggauacaaagaucgaccugugguccuauaaugccgaacuccugguggcucuggagaaccaacauaccauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcguggaacucaaauccggauacaaggauuggauucuguggaucagcuuugccauuucuugcuuccuucugugugucgcccuccugggcuuuaucaugugggcuugccagaaagggaacauccgguguaauauuugcaucuga

SEQ ID NO: 191144 - RNA, 1701 nt, Artificial Sequence
  derived and/or modified sequence opt5 from hemagglutinin__InfluenzaA__AEX36410
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacagcuuuuucucccggcugaauuggcucacacaucugaaguuuaaguauccugcccuuaacgucaccaugcccaacaaugagaaauucgacaagcuguacauuuggggcgugcaccauccugggacggauaacgaccagaucuuucucuaugcgcaggccagcggacgcauuacaguuucuaccaaaagaucccaacagacagugaucccgaauauuggcagccggccccgcgucagaaacaucccuucccggaucucuauuuacuggaccaucgugaagcccggggauauucugcugaucaauagcaccggaaaccucauugcuccucgcggcuacuucaaaaucagauccgggaagucuucuaucaugcgguccgacgcccccauuggaaaguguaauagcgaaugcaucacaccgaacggcucuauuccuaaugacaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggaugggugguauggauucagacaccagaauagcgagggcauuggccaggcugccgaccugaaauccacacaagcugccaucgaucagauuaacgggaagcucaaccggcugaucggaaaaaccaaugaaaaguuccaccagauugagaaggaauuuucugagguggaaggcagaauccaggaccuugagaaauacgucgaggauacgaagauugaccuguggagcuauaacgccgaacuccugguggcucuggagaaucaacauacaaucgaucucaccgacuccgaaaugaacaaacuguucgagaagaccaaaaagcagcuucgcgaaaaugcggaggauauggggaacggaugcuuuaagaucuaccacaaaugugacaaugccugcauuggcagcauccggaacgggacauaugaucaugacguuuacagagacgaggcucugaauaaccgcuuccagauuaagggcguggaacucaaaucuggauacaaggauuggauccuguggauuuccuuugccaucagcugcuuccuucugugugucgcccuccugggcuuuaucaugugggcuugccagaaagggaauauucgguguaacaucugcauuuga

SEQ ID NO: 191145 - RNA, 1701 nt, Artificial Sequence; identical to SEQ ID NO: 185458
  derived and/or modified sequence opt5 from hemagglutinin__InfluenzaA__AEX36421

SEQ ID NO: 191146 - RNA, 1701 nt, Artificial Sequence
  derived and/or modified sequence opt5 from hemagglutinin__InfluenzaA__AEX36432
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagguccuugauggggaaaauuguacccugaucgacgcccuccugggagauccccagugcgacggcuuucaaaacaaaaagugggaucuguucguggagagaagcaaagccuauuccaauuguuacccuuaugacguucccgauuacgcuucucuccggagccugguggccuccagcgggacgcuugaauuuaacaaugagucuuucaacuggaccggagucacacagaauggcaccuccagcgcuugcauucgcagaucuaacaauuccuuuuucagccggcugaacuggcucacacaucugaaguuuaaguauccugcccuuaaugugaccaugcccaacaacgagcaguucgacaaacuguacaucuggggcguucaccauccugggacggauaaugaccagauuuuucucuaugcgcaagccucuggacgcaucacaguguccaccaagagaagccagcagacagucauuccgaacaucggcucccggccccgcgugagaaauauuccuucucggaucagcaucuacuggaccauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugucaaccgcauuacguauggcgcuuguccuagauacguuaaacaaaauacccugaaacuugccacagggaugcggaacgugcccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgaggucgaaggccgcauccaagaccuugagaaguacguggaggauacgaaaauugaccugugguccuauaaugccgaacuccugguugcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 191147 - RNA, 1701 nt, Artificial Sequence
  derived and/or modified sequence opt5 from hemagglutinin__InfluenzaA__AEX36443
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguauccugcccuuaacgucaccaugcccaacaaugaggaguucgauaaacuguacauuuggggcgugcaccauccugggacggacaacgaucagaucuuucucuaugcgcaggccucuggacgcauuacaguuuccaccaagagaagccaacagacagugaucccgaauauuggcucccggccccgcgucagaaacaucccuucucggaucagcauuuacuggaccaucgugaaacccggggacauucugcugaucaauuccaccggaaaccucauugcuccucgcggcuacuucaagaucagaagcgggaaaucuuccaucaugcggagcgaugcccccauuggaaaguguaauucugaaugcaucacaccgaacggcagcauuccuaaugacaagcccuuucagaacgugaaucgcaucacguauggcgcuuguccuagauacgucaaacagaacacccugaaacuugccacagggaugcggaauguucccgaaaaacaaacccgcggaauuuucggcgcgaucgccggguuuaucgagaacggaugggagggcaugguggacgggugguauggauucagacaccaaaauuccgaaggcauuggccaggcugccgaucugaagucuacacaggcugccaucgaccagauuaacgggaaacucaaccggcugaucggaaagaccaaugagaaauuccaccagauugaaaaggaguuuagcgaaguggagggcagaauccaggaucuugagaaguacgucgaagacacgaaaauugaucugugguccuauaacgccgagcuccugguggcucuggaaaaucaacauacaaucgaccucaccgauagcgagaugaacaagcuguucgaaaagaccaagaaacagcuucgcgagaaugcggaggacauggggaacggaugcuuuaagaucuaccacaagugugauaaugccugcauuggcucuauccggaacgggacauaugaccaugauguuuacagagacgaagcucugaauaaccgcuuccagauuaaaggcguggagcucaaguccggauacaaagacuggauccuguggauuagcuuugccaucucuugcuuccuucugugugucgcccuccugggcuuuaucaugugggcuugccagaaggggaauauucgguguaacaucugcauuuga

SEQ ID NO: 191148 - RNA, 1701 nt, Artificial Sequence
  derived and/or modified sequence opt5 from hemagglutinin__InfluenzaA__AEX36454
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguauccugcccuuaacgucaccaugcccaacaaugaggaguucgauaaacuguacauuuggggcgugcaccauccugggacggacaacgaucagaucuuucucuaugcgcaggccucuggacgcauuacaguuuccaccaagagaagccaacagacagugaucccgaauauuggcucccggccccgcgucagaaacaucccuucucggaucagcauuuacuggaccaucgugaaacccggggacauucugcugaucaauuccaccggaaaccucauugcuccucgcggcuacuucaagaucagaagcgggaaaucuuccaucaugcggagcgaugcccccauuggaaaguguaauucugaaugcaucacaccgaacggcagcauuccuaaugacaagcccuuucagaacgugaaucgcaucacguauggcgcuuguccuagauacgucaaacagaacacccugaaacuugccacagggaugcggaauguucccgaaaaacaaacccgcggaauuuucggcgcgaucgccggguuuaucgagaacggaugggagggcaugguggacgggugguauggauucagacaccaaaauuccgaaggcauuggccaggcugccgaucugaagucuacacaggcugccaucgaccagauuaacgggaaacucaaccggcugaucggaaagaccaaugagaaauuccaccagauugaaaaggaguuuagcgaaguggagggcagaauccaggaucuugagaaguacgucgaagacacgaaaauugaucugugguccuauaacgccgagcuccugguggcucuggaaaaucaacauacaaucgaccucaccgauagcgagaugaacaagcuguucgaaaagaccaagaaacagcuucgcgagaaugcggaggacauggggaacggaugcuuuaagaucuaccacaagugugauaaugccugcauuggcucuauccggaacgggacauaugaccaugauguuuacagagacgaagcucugaauaaccgcuuccagauuaaaggcguggagcucaaguccggauacaaagacuggauccuguggauuagcuuugccaucucuugcuuccuucugugugucgugcuccugggcuuuaucaugugggccugccagaaggggaauauucgguguaacaucugcauuuga

SEQ ID NO: 191149 - RNA, 1701 nt, Artificial Sequence; identical to SEQ ID NO: 184753
  derived and/or modified sequence opt5 from hemagglutinin__InfluenzaA__AEX36465

SEQ ID NO: 191150 - RNA, 1701 nt, Artificial Sequence
  derived and/or modified sequence opt5 from hemagglutinin__InfluenzaA__AEX36476
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauuggaccggcgugacacagaacggcaccuccagcgcuugcaagcgcgggucuaauaacuccuuuuucagcagacugaauuggcucacacauucuaaguuuaaauauccugcccugaacgucaccaugcccaauaacgaggaguucgacaaacuuuacauuuggggagugcaccauccuggcacggauaacgaccagaucuuuccguaugcgcaggccuccgggcggauuacaguuagcaccaagcgcucccaacagacagugauccccaauauuggaucuagaccucggauccgcaacauccccagcagaauuuccaucuacuggaccauugucaagccuggcgauauccugcucauuaauagcaccgggaaccugaucgcuccccggggauacuucaaaauccgcucuggcaaguccagcauuaugagaucugacgccccgaucggcaagugugacagcgaaugcauuacaccuaauggguccauccccaacgauaaaccuuuucagaaugugaaccggauuacguauggagcuuguccccgcuacgugaagcagaauacccugaaacucgccacaggcaugagaaacguccccgagaagcaaacccgggggaucuucggagcgaucgccggcuuuauugaaaaugggugggagggaaugguugacggcugguauggcuuccgccaccagaacucugaggggaucggacaggcugccgaucugaaaagcacacaagcugccauugaccagaucaauggcaaacuuaacagacugauugggaagaccaaugaaaaguuccaccagaucgagaaggaauuuuccgagguggaaggacggauucaggaucucgagaaauacguggaggacacgaagaucgaucuguggagcuauaacgccgaacuucuggucgcucucgagaaccaacauacaaucgaccugaccgauucugaaaugaauaaacuguucgagaagaccaaaaagcagcucagagaaaacgcggaggacaugggcaaugggugcuuuaagauuuaccacaaaugugauaacgccugcaucggcuccauucgcaauggaacauaugaccaugacguguaccgggaugaggcucugaacaauagauuccagaucaagggcguugaacuuaaaagcggguacaaggacuggauucuguggaucucuuuugccaucuccugcuuccuccuguguguggcccuucugggauuuauuaugugggcuugccagaaaggcaacauccgcuguaauauuugcaucuga

SEQ ID NO: 191151 - RNA, 1701 nt, Artificial Sequence
  derived and/or modified sequence opt5 from hemagglutinin__InfluenzaA__AEX36487
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauuggaccggcgugacacagaacggcaccuccagcgcuugcaagcgcgggucuaauaacuccuuuuucagcagacugaauuggcucacacauucuaaguuuaaauauccugcccugaacgucaccaugcccaauaacgaggaguucgacaaacuuuacauuuggggagugcugcacccuggcacggauaacgaccagaucuuucucuaugcgcaggccuccgggcggauuacaguuagcaccaagcgcucccaacagacagugaucccgaauauuggaucuagaccccggguccgcaacaucccuagcagaaucuccauuuacuggaccaucgugaagcccggcgauauucugcugaucaauagcaccgggaaccucauugcuccucggggauacuucaaaauccgcucuggcaaguccagcaucaugagaucugacgcccccauuggcaaguguaauagcgaaugcaucacaccgaacggguccauuccuaaugacaaacccuuucagaacgugaaucggaucacguauggagcuuguccucgcuacgucaagcagaacacccugaaacuugccacaggcaugagaaauguucccgagaagcaaacccgggggauuuucggagcgaucgccggcuuuaucgaaaacgggugggagggaaugguggauggcugguauggcuuccgccaucaaaauucugaggggauuggacaggcugccgaccugaaaagcacacaggcugccaucgaucagauuaacggcaagcucaauagacugaucgggaaaaccaacgaaaaguuccaccagauugagaaggaauuuuccgagguggaaggacggauccaggaccuugagaaauacgucgaggauacgaagauugaccuguggagcuauaacgccgaacuccugguggcucuggagaaucaacacacaaucgaucucaccgacucugaaaugaacaaacuguucgagaagaccaaaaagcagcuuagagaaaaugcggaggauaugggcaacgggugcuuuaagaucuaccauaaaugugacaaugccugcauuggcuccauccgcaacggaacauaugaucacgacguuuaccgggacgaggcucugaauaacagauuccagauuaagggcguggaacucaaaagcggguacaaggauuggauccuguggauuucuuuugccaucuccugcuuccuucugugugucgcccuccugggauuuaucaugugggcuugccagaaaggcaauauucgcuguaacaucugcauuuga

SEQ ID NO: 191152 - RNA, 1701 nt, Artificial Sequence; identical to SEQ ID NO: 191002
  derived and/or modified sequence opt5 from hemagglutinin__InfluenzaA__AEX36498

SEQ ID NO: 191153 - RNA, 1701 nt, Artificial Sequence
  derived and/or modified sequence opt5 from hemagglutinin__InfluenzaA__AEX36509
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuuccguaugcgcaggccucugggcggauuacaguuuccaccaagcgcagccaacagacagugauccccaacauuggauccagaccucggguccgcaauauccccucuagaaucagcauuuacuggaccaucgugaagccuggcgauauucugcucaucaacuccaccgggaaucugauugcuccccggggauacuucaaaauccgcagcggcaagucuuccaucaugagaagcgacgccccgauuggcaaguguaacucugaaugcaucacaccuaaugggagcauucccaacgacaaaccuuuucagaaugugaaccggaucacguauggagcuuguccccgcuacgucaagcagaauacccugaaacucgccacaggcaugagaaacguucccgagaagcaaacccgggggauuuucggagcgaucgccggcuuuaucgaaaaugggugggagggaaugguggauggcugguauggcuuccgccaccagaacuccgaggggauuggacaggcugccgaccugaaaucuacacaagcugccaucgaucagauuaauggcaaacuuaacagacugaucgggaagaccaacgaaaaguuccaccagauugagaaggaauuuagcgagguggaaggacggauccaggaccucgagaaauacgucgaggauacgaagauugaccugugguccuauaaugccgaacuucugguggcucucgagaaccaacauacaaucgaucugaccgacagcgaaaugaauaaacuguucgagaagaccaaaaagcagcucagagaaaacgcggaggauaugggcaaugggugcuuuaagaucuaccacaaaugugacaacgccugcauuggcucuauccgcaauggaacauaugaucaugacguuuaccgggacgaggcucugaacaauagauuccagauuaagggcguggaacuuaaauccggguacaaggauuggauccuguggauuagcuuugccaucucuugcuuccuccugugugucgcccuucugggauuuaucaugugggcuugccagaaaggcaacauucgcuguaauaucugcauuuga

SEQ ID NO: 191154 - RNA, 1701 nt, Artificial Sequence
  derived and/or modified sequence opt5 from hemagglutinin__InfluenzaA__AEX36520
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucauaacguuuaccgcgacgaggcucugaauaaccgguuccagaucaaaggcguggaacucaaguccggauacaaagacuggauucuguggaucagcuuugccauuucuugcuuccuucugugugucgcccuccugggcuuuaucaugugggcuugccaaaaggggaauaucagauguaacauuugcaucuga

SEQ ID NO: 191155 - RNA, 1701 nt, Artificial Sequence
  derived and/or modified sequence opt5 from hemagglutinin__InfluenzaA__AEX36531
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaaacagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugauaaguacgucgaggacacgaaaaucgaucugugguccuauaaugccgagcuccugguggcucuggaaaaccagcauacaauugaccucaccgauagcgagaugaauaagcuguucgaaaagaccaagaaacagcuucgggagaacgcggaagacauggggaauggaugcuuuaagaucuaccacaagugugauaacgccugcaucggcucuauuagaaaugggacauaugaccaugacguuuaccgcgaugaggcucugaacaaucgguuccagaucaaaggcguggagcucaaguccggauacaaagacuggauucuguggaucagcuuugccauuucuugcuuccuucugugugucgcccuccugggcuuuaucaugugggcuugccaaaaggggaacaucagauguaauauuugcaucuga

SEQ ID NO: 191156 - RNA, 1701 nt, Artificial Sequence
  derived and/or modified sequence opt5 from hemagglutinin__InfluenzaA__AEX36542
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaaguuuaaguauccugcccuuaacgucaccaugcccaacaaugagcaguucgacaaacuguacauuuggggcgugcaccauccugggacggauaacgaccagaucuuucucuaugcgcaagccagcggacgcauuacaguuucuaccaagagaucccagcagacagugaucccgaauauuggcagccggccccgcgucagaaacaucccuucccggaucucuauuuacuggaccaucgugaaacccggggauauucugcugaucaauagcaccggaaaccucauugcuccucgcggcuacuucaagaucagauccgggaaaagcucuaucaugcgguccgacgcccccauuggaaaguguaauagcgaaugcaucacaccgaacggcucuauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggaugggugguauggauucagacaccagaauagcgagggccggggccaagcugccgaccugaaguccacacaggcugccauugaucagaucaacgggaaacucaacagacugauuggaaagaccaaugaaaaauuccaccagaucgagaaggaauuuucugagguggaaggccgcauucaagaccuugagaaguacgucgaggauacgaaaaucgaccuguggagcuauaacgccgaacuccugguggcucuggagaaucagcauacaauugaucucaccgacuccgaaaugaacaagcuguucgagaaaaccaagaaacagcuucgggaaaaugcggaggauauggggaacggaugcuuuaagaucuaccacaagugugacaaugccugcaucggcagcauuagaaacgggacauaugaucaugacguuuaccgcgacgaggcucugaauaaccgguuccagaucaaaggcguggaacucaagucuggauacaaagauuggauucuguggaucuccuuugccauuagcugcuuccuucugugugucgcccuccugggcuuuaucaugugggcuugccaaaaggggaauaucagauguaacauuugcaucuga

SEQ ID NO: 191157 - RNA, 1701 nt, Artificial Sequence; identical to SEQ ID NO: 191156
  derived and/or modified sequence opt5 from hemagglutinin__InfluenzaA__AEX36553

SEQ ID NO: 191158 - RNA, 1701 nt, Artificial Sequence; identical to SEQ ID NO: 191156
  derived and/or modified sequence opt5 from hemagglutinin__InfluenzaA__AEX36564

SEQ ID NO: 191159 - RNA, 1701 nt, Artificial Sequence
  derived and/or modified sequence opt5 from hemagglutinin__InfluenzaA__AEX36575
augaagaccaucauugcccugagcuacauccucugccugguguucgcucagaaacuucccggcaacggaaauuccacagccacgcugugucucgggcaccaugcggucccuaacggcaccauuguuaagacaaucaccaaugaccaaauugaggugacaaacgcuaccgaacuggugcagucuagcuccacaggggagaucugcgauucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucaacuggaccggcgugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgauaaacuguacauuuggggagugcaccauccugggacggacaaugaucagaucuuucucuaugcgcaagccucuggccgcauuacaguuuccaccaagagaagccagcagacagugaucccgaacauugggucccggccccgcgucagaaauaucccuucucggaucagcauuuacuggaccaucgugaaacccggagacauucugcugaucaacuccaccggcaaucucauugcuccucgcggguacuucaagaucagaagcggaaaaucuuccaucaugcggagcgaugcccccauuggcaaguguaacucugaaugcaucacaccgaauggcagcauuccuaacgacaagcccuuucagaaugugaaccgcaucacguauggggcuuguccuagauacgucaaacaaaauacccugaaacuugccacaggaaugcggaacguucccgagaagcagacccgcggcauuuucggggcgaucgccggauuuaucgaaaauggcugggaggggaugguggacggaugguauggcuucagacaccagaacuccgagggccgggggcaagcugccgaucugaagucuacacaggcugccauugaccagaucaauggaaaacucaacagacugauuggcaagaccaacgaaaaauuccaccagaucgagaaggaauuuagcgagguggaagggcgcauucaagaucuugagaaguacgucgaggacacgaaaaucgauauuugguccuauaaugccgaacugcucguggcucuggagaaccagcauacaaucgaccugaccgauagcgaaaugaauaaacucuucgagaagaccaagaaacagcugcgggaaaacgcggaggacaugggaaauggcugcuuuaagaucuaccacaagugugauaacgccugcauugggucuaucagaaauggcacauaugaccaugauguuuaccgcgacgaggcucuuaacaaucgguuccagauuaaaggaguggaacugaaguccggcuacaaagacuggauccucuggauuagcuuugccaucucuugcuuccugcuuugugucgcccugcucggguuuaucaugugggcuugccaaaagggaaacauuagauguaauaucugcauuuga

SEQ ID NO: 191160 - RNA, 1701 nt, Artificial Sequence
  derived and/or modified sequence opt5 from hemagglutinin__InfluenzaA__AEX36586
augaagaccaucauugcccugagcuacauccucugccugguguucgcucagaaacuucccggcaacgacaauaacacagccacgcugugucucgggcaccaugcggucccuaauggaaccauuguuaagacaaucaccaacgaucaaauugaggugacaaaugcuaccgaacuggugcaguccucuagcacaggcgagaucugcgacuccccgcaccagauccuugauggggaaaacuguacccugauugacgcccuccugggagauccccagugcgacggcuuucaaaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaaguuuaaguauccugcccuuaacgucaccaugcccaacaaugagcaguucgacaaacuguacauuuggggcgugcaccauccugggacggauaacgaccagaucuuucucuaugcgcaagccagcggacgcauuacaguuucuaccaagagaucccagcagacagugaucccgaauauuggcagccggccccgcgucagaaacaucccuucccggaucucuauuuacuggaccaucgugaaacccggggauauucugcugaucaauagcaccggaaaccucauugcuccucgcggcuacuucaagaucagauccgggaaaagcucuaucaugcgguccgacgcccccauuggaaaguguaauagcgaaugcaucacaccgaacggcucuauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggaugggugguauggauucagacaccagaauagcgagggccggggccaagcugccgaccugaaguccacacaggcugccauugaucagaucaacgggaaacucaacagacugauuggaaagaccaaugaaaaauuccaccagaucgagaaggaauuuucugagguggaaggccgcauucaagaccuugagaaguacgucgaggauacgaaaaucgaccuguggagcuauaacgccgaacuccugguggcucuggagaaucagcauacaauugaucucaccgacuccgaaaugaacaagcuguucgagaaaaccaagaaacagcuucgggaaaaugcggaggauauggggaacggaugcuuuaagaucuaccacaagugugacaaugccugcaucggcagcauuagaaacgggacauaugaucaugacguuuaccgcgacgaggcucugaauaaccgguuccagaucaaaggcguggaacucaagucuggauacaaagauuggauucuguggaucuccuuugccauuagcugcuuccuucugugugucgcccuccugggcuuuaucaugugggcuugccaaaaggggaauaucagauguaacauuugcaucuga

SEQ ID NO: 191161 - RNA, 1701 nt, Artificial Sequence
  derived and/or modified sequence opt5 from hemagglutinin__InfluenzaA__AEX36597
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauccgcagaucuaacaauuccuuuuucagccggcugaacuggcucacccaucugaaguuuaaguauccugcccuuaaugucacaaugcccaacaacgagcaguucgacaaacuguacauuuggggcgugcaccauccugggaccgauaaugaccagaucuuucucuaugcgcaagccucuggacgcauuacgguuuccacaaagagaagccagcagaccgugaucccgaacauuggcucccggccccgcgucagaaauaucccuucucggaucagcauuuacuggacaaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucaccccgaauggcagcauuccuaacgacaagcccuuucagaaugugaaccgcaucacauauggcgcuuguccuagauacgucaaacaaaauacgcugaaacuugccaccgggaugcggaacguucccgagaagcagacacgcggaauuuucggcgcgaucgccggguuuaucgaaaauggaugggagggcaugguggaugggugguauggauucagacaccagaacuccgagggccggggccaagcugccgaccugaagucuacccaggcugccauugaucagaucaaugggaaacucaacagacugauuggaaagacaaacgaaaaauuccaccagaucgagaaggaauuuagcgagguggaaggccgcauucaagaccuugagaaguacgucgaggauaccaaaguggaccugugguccuauaaugccgaacuccugguugcucuggagaaccagcauacgaucgaucucacagacagcgaaaugaauaagcuguucgagaaaaccaagaaacagcuucgggaaaacgcggaggauauggggaauggaugcuuuaagauuuaccacaagugugacaacgccugcaucggcucuaucagaaaugggaccuaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 191162 - RNA, 1701 nt, Artificial Sequence
  derived and/or modified sequence opt5 from hemagglutinin__InfluenzaA__AEX36608
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaaacuucaauuggaccggcgugacacagaacggcaccucuuccgcuugcaagcgcagaagcaauaacuccuuuuucucucggcugaauuggcucacacaucugaaguuuaaauauccugcccuuaacgucaccaugcccaacaaugagaaguucgacaaacuguacaucuggggagugcaccauccugggacggauaacgaccagauuuuucucuaugcgcaggccagcggccgcaucacaguuucuaccaagagaucccaacagacagugauuccgaauaucgggagccggccccgcgucagaaacauuccuucccggaucucuaucuacuggaccauugugaaacccggagauauccugcugauuaauagcaccggcaaccucaucgcuccucgcggguacuucaagauuagauccggaaagagcucuaucaugcgguccgacgcccccaucggcaaauguaauagcgagugcauuacaccgaacggcucuaucccuaaugacaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggauggaugguauggcuucagacaccagaauagcgagggcaucgggcaggcugccgaccugaaguccacacaagcugccauuaaccagaucaacggaaaacucaaucggcugauuggcaagaccaacgagaaguuccaccagaucgaaaaagaguuuucugaaguggaggggcgcauucaggaucuugaaaaguacgucgaggacacgaaaaucgaucuguggagcuauaaugccgagcuccugguggcucuggaaaaccaacauacaauugaccucaccgauuccgagaugaauaagcuguucgaaagaaccaaaaagcagcuucgggagaacgcggaagacaugggaaauggcugcuuuaagaucuaccacaaaugugauaacgccugcaucgggagcauuagaaauggcacauaugaccaugauguuuaccgcgacgaggcucugaacaagcgguuccagaucaaaggaguggagcucaagucuggcuacaaagacuggauucuguggaucuccuuugccauuagcugcuuccuucugugugucgcccuccugggguuuaucaugugggcuugccagaagggaaauaucagauguaacauuugcaucuga

SEQ ID NO: 191163 - RNA, 1701 nt, Artificial Sequence; identical to SEQ ID NO: 190985
  derived and/or modified sequence opt5 from hemagglutinin__InfluenzaA__AEX36619

SEQ ID NO: 191164 - RNA, 1701 nt, Artificial Sequence
  derived and/or modified sequence opt5 from hemagglutinin__InfluenzaA__AEX63617
auggaggccaagcuguucgugcucuuuugcgcuuucaccgcccugaaagcggacacaaucugugucggcuaccacgcuaacaauagcacggauaccguugacacaauucuugaaaagaacgugaccgugacacauuccgucaaucugcucgagaacucucacaaugggaaacugugcagccuuaacggaaagaucccccugcagcucggcaauuguaacguggccggguggauucugggaaauccuaaaugcgaucugcuccugaccgccaacuccuggucuuauaucauugaaacaagcaauuccaagaacggcgcuuguuacccgggggaguuugccgacuaugaagaacuuaaggagcaacugucuaccguuagcuccuucgaaagauuugagaucuuccccaaagcuacgagcuggccuaaucaugauaccacacggggaaccacaguggccugcucucacuccggcgcgaacagcuuuuaccgcaaucuccuguggaucgucaagaaaggcaacucuuaucccaaacuuuccaaaagcuacaccaacaauaaggggaaggaagugcugguuauuuggggagugcaucacccucccacggacucuguccagcagacacucuaucagaacaaucacaccuacguguccgugggcagcuccaaauacuauaagagauucacaccugagaucgucgcccggccgaaaguucgcgagcaagcugggagaaugaacuacuauuggacccugcuggaucagggagacaccauuacauuugaagccacgggcaaucucaucgcucccuggcaugccuucgcgcugaagaaagggucuagcuccggaauuaugcggagcgaugcccaggugcacaacuguaccacaaagugccagaccccucauggcgcucuuaaaggcaaucugcccuuucaaaacgugcacccugucacaaucggggagugucccaaguacgugaagucuacccagcuccgcauggccacgggacugagaaauauuccguccauccagagccggggccuuuucggggcuaucgccggauuuauugaaggcggguggacaggaaugguugacggcugguauggcuaccaccaucgcaacgagcaggggucuggauaugccgcugaucaaaagagcacccagaucgcgauugacggcaucuccaauaaggugaacucugucauugagaaaaugaauauccaguucaccagcguggggaaggaguucaacucccuggagaaaagaauggaaaaucucaacaagaagguugaugacggauuucuggacguguggacauacaacgccgagcugcucauccugcuugaaaaugagcggacccuggauuuccacgaccucaacgucaaaaaucuguacgaaaaggugaaaagccaacuucgcaacaaugcuaaggagauuggcaacgggugcuuugaguucuaucauaaaugugauaaugaaugcauggagucugucaagaacggcacauacaauuaucugaaguacuccgaagagagcaaacucaacagagaagagaucgacggagugaagcuggagucuaugggcauucaccagauccuggccauuuauuccacgguugccagcucccucgugcugcuugucucucugggggcuaucagcuuuuggaugugcuccaauggaucucuccagugucgggugugcaucuga

SEQ ID NO: 191165 - RNA, 1698 nt, Artificial Sequence; identical to SEQ ID NO: 186302
  derived and/or modified sequence opt5 from hemagglutinin__InfluenzaA__AEX92873

SEQ ID NO: 191166 - RNA, 1701 nt, Artificial Sequence; identical to SEQ ID NO: 186857
  derived and/or modified sequence opt5 from hemagglutinin__InfluenzaA__AEY69088

SEQ ID NO: 191167 - RNA, 1701 nt, Artificial Sequence; identical to SEQ ID NO: 186454
  derived and/or modified sequence opt5 from hemagglutinin__InfluenzaA__AEY69098

SEQ ID NO: 191168 - RNA, 1701 nt, Artificial Sequence; identical to SEQ ID NO: 186435
  derived and/or modified sequence opt5 from hemagglutinin__InfluenzaA__AEY69120

SEQ ID NO: 191169 - RNA, 1701 nt, Artificial Sequence; identical to SEQ ID NO: 186637
  derived and/or modified sequence opt5 from hemagglutinin__InfluenzaA__AEY69131

SEQ ID NO: 191170 - RNA, 1701 nt, Artificial Sequence; identical to SEQ ID NO: 190012
  derived and/or modified sequence opt5 from hemagglutinin__InfluenzaA__AEY69153

SEQ ID NO: 191171 - RNA, 1701 nt, Artificial Sequence; identical to SEQ ID NO: 186637
  derived and/or modified sequence opt5 from hemagglutinin__InfluenzaA__AEY69164

SEQ ID NO: 191172 - RNA, 1701 nt, Artificial Sequence; identical to SEQ ID NO: 186637
  derived and/or modified sequence opt5 from hemagglutinin__InfluenzaA__AEY69175

SEQ ID NO: 191173 - RNA, 1701 nt, Artificial Sequence; identical to SEQ ID NO: 186637
  derived and/or modified sequence opt5 from hemagglutinin__InfluenzaA__AEY69186

SEQ ID NO: 191174 - RNA, 1701 nt, Artificial Sequence; identical to SEQ ID NO: 186637
  derived and/or modified sequence opt5 from hemagglutinin__InfluenzaA__AEY69197

SEQ ID NO: 191175 - RNA, 1701 nt, Artificial Sequence; identical to SEQ ID NO: 186637
  derived and/or modified sequence opt5 from hemagglutinin__InfluenzaA__AEY69208

SEQ ID NO: 191176 - RNA, 1701 nt, Artificial Sequence; identical to SEQ ID NO: 186637
  derived and/or modified sequence opt5 from hemagglutinin__InfluenzaA__AEY69219

SEQ ID NO: 191177 - RNA, 1701 nt, Artificial Sequence; identical to SEQ ID NO: 186435
  derived and/or modified sequence opt5 from hemagglutinin__InfluenzaA__AEY69258

SEQ ID NO: 191178 - RNA, 1701 nt, Artificial Sequence; identical to SEQ ID NO: 186637
  derived and/or modified sequence opt5 from hemagglutinin__InfluenzaA__AEY69269

SEQ ID NO: 191179 - RNA, 1701 nt, Artificial Sequence; identical to SEQ ID NO: 186435
  derived and/or modified sequence opt5 from hemagglutinin__InfluenzaA__AEY69291

SEQ ID NO: 191180 - RNA, 1701 nt, Artificial Sequence; identical to SEQ ID NO: 186435
  derived and/or modified sequence opt5 from hemagglutinin__InfluenzaA__AEY69302

SEQ ID NO: 191181 - RNA, 1701 nt, Artificial Sequence; identical to SEQ ID NO: 186435
  derived and/or modified sequence opt5 from hemagglutinin__InfluenzaA__AEY69313

SEQ ID NO: 191182 - RNA, 1701 nt, Artificial Sequence; identical to SEQ ID NO: 186435
  derived and/or modified sequence opt5 from hemagglutinin__InfluenzaA__AEY69785

SEQ ID NO: 191183 - RNA, 1701 nt, Artificial Sequence
  derived and/or modified sequence opt5 from hemagglutinin__InfluenzaA__AEY69807
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggccugcaaaacaagaaaugggaucucuuugucgaaagaagcaaggccuauuccaauuguuacccuuaugacgugcccgauuacgcuucucugcggagccuuguugccuccagcgggacgcuggaguucaacaaugaaucuuuuaacuggaccggagugacacagaauggcaccuccagcgcuugcauccgcagaucuaagaacuccuucuuuagccggcucaauuggcugacacaucuuaacuucaaauauccugcccugaaugucaccaugcccaacaacgagcaguuugacaagcucuacauuuggggcgugcaccauccugggacggauaaagaccagaucuuccuguaugcgcaagccucuggacgcauuacaguuuccaccaagagaagccagcagacagcuaucccgaauauuggcucccggccccgcgugagaaacaucccuucucggaucagcauuuacuggaccaucgucaaacccggggauauucugcucaucaauuccaccggaaaccugauugccccucgcggcuacuuuaaacuuagaagcgggaagucuuccaucaugcggagcgacgcucccaucggaaaauguaauucugagugcauuacaccgaacggcagcaucccuaaugacaagcccuuccagaacgugaaucgcauuacguauggcgccuguccuagauacgugaaacaaaacacccugaagcucgcgacagggaugcggaauguccccgaaaaacagacccgcggaaucuuuggcgccauugcuggguucaucgagaacggaugggaaggcaugguugaugggugguauggauuuagacaccaaaauuccgagggccggggccaggccgcugaccugaagucuacacaggccgccaucgaucagauuaacgggaaacuuaauagacugaucggaaagaccaacgagaaguuccaccagauugaaaaagaguucagcgaaguggagggccgcauccaagaccucgaaaaguacguggaggauacgaaaauugaccugugguccuauaacgcugagcugcucgucgcgcuggaaaaucagcauacaaucgaucuuaccgacagcgagaugaacaagcuguuugaaaagaccaagaagcagcuccgggagaaugccgaagauauggggaacggaugcuucaaaauuuaccacaagugugacaaugcuugcaucggcucuaucagaaacgggacauaugaucaugacguguaccgcgacgaggcccugaauaaccgguuucagauuaaaggcguugagcuuaaguccggauacaaagauuggauccuguggauuagcuucgccaucucuugcuuucuccuguguguggcucugcucggcuucauuaugugggccugccaaaaggggaauaucagauguaacaucugcauuuga

SEQ ID NO: 191184 - RNA, 1701 nt, Artificial Sequence; identical to SEQ ID NO: 186637
  derived and/or modified sequence opt5 from hemagglutinin__InfluenzaA__AEY69818

SEQ ID NO: 191185 - RNA, 1701 nt, Artificial Sequence; identical to SEQ ID NO: 186637
  derived and/or modified sequence opt5 from hemagglutinin__InfluenzaA__AEY69829

SEQ ID NO: 191186 - RNA, 1701 nt, Artificial Sequence; identical to SEQ ID NO: 186637
  derived and/or modified sequence opt5 from hemagglutinin__InfluenzaA__AEY69840

SEQ ID NO: 191187 - RNA, 1701 nt, Artificial Sequence; identical to SEQ ID NO: 186637
  derived and/or modified sequence opt5 from hemagglutinin__InfluenzaA__AEY69851

SEQ ID NO: 191188 - RNA, 1701 nt, Artificial Sequence; identical to SEQ ID NO: 186637
  derived and/or modified sequence opt5 from hemagglutinin__InfluenzaA__AEY69873

SEQ ID NO: 191189 - RNA, 1701 nt, Artificial Sequence; identical to SEQ ID NO: 186637
  derived and/or modified sequence opt5 from hemagglutinin__InfluenzaA__AEY69884

SEQ ID NO: 191190 - RNA, 1701 nt, Artificial Sequence; identical to SEQ ID NO: 186637
  derived and/or modified sequence opt5 from hemagglutinin__InfluenzaA__AEY69895

SEQ ID NO: 191191 - RNA, 1701 nt, Artificial Sequence; identical to SEQ ID NO: 190012
  derived and/or modified sequence opt5 from hemagglutinin__InfluenzaA__AEY69906

SEQ ID NO: 191192 - RNA, 1701 nt, Artificial Sequence; identical to SEQ ID NO: 186637
  derived and/or modified sequence opt5 from hemagglutinin__InfluenzaA__AEY69917

SEQ ID NO: 191193 - RNA, 1701 nt, Artificial Sequence
  derived and/or modified sequence opt5 from hemagglutinin__InfluenzaA__AEY69939
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauucgcagaucuaagaacuccuuuuucagccggcuuaauuggcugacacaucucaacuuuaaauauccugcccugaaugucaccaugcccaacaacgagcaguucgacaaacuuuacaucuggggcgugcaccauccugggacggauaaggaccagauuuuucuguaugcgcaagccucuggacgcaucacaguuuccaccaagagaagccagcagacagcuauuccgaauaucggcucccggccccgcgugagaaacaucccuucucggauuagcaucuacuggaccauugucaaacccggggauauccuccugauuaauuccaccggaaaccugaucgccccucgcggcuacuucaagaucagaagcgggaagucuuccauuaugcggagcgacgcucccaucggaaaauguaauucuggcugcauuacaccgaacggcagcaucccuaaugacaagcccuuucagaacgugaaucgcauuacguaugggguguguccuagauacgucaaacaaaacacccucaagcuggccacaggaaugcggaauguucccgagaaacagacccgcggcaucuucggggcgaucgccggauuuauugaaaacggcugggaggggaugguggauggaugguauggcuucagacaccaaaauuccgaaggccgggggcaggcugccgaccuuaagucuacacaggcugccaucgaucagauuaacggaaaacugaauagacucaucggcaagaccaacgagaaguuccaccagauugagaaagaauuuagcgagguggaagggcgcauccaagaccuggagaaguacgucgaagauacgaaaauugaccuuugguccuauaacgccgagcugcucguggcucuggagaaucagcauacaaucgaucugaccgacagcgaaaugaacaaacucuucgagaagaccaagaagcagcugcgggaaaaugcggaggauaugggaaacggcugcuuuaaaaucuaccacaagugugacaaugccugcauugggucuaucagaaacggcacauaugaucaugacguuuaccgcgacgaagcucuuaauaaccgguuccagauuaaaggaguggagcugaaguccggcuacaaagauugguuucucuggaucagcuucgccauuucuugcuuucugcuuugugucgcccugcucggguucaucaugugggcuugccaaaagggaaauaucagauguaacauuugcaucuga

SEQ ID NO: 191194 - RNA, 1701 nt, Artificial Sequence; identical to SEQ ID NO: 191193
  derived and/or modified sequence opt5 from hemagglutinin__InfluenzaA__AEY69950

SEQ ID NO: 191195 - RNA, 1701 nt, Artificial Sequence; identical to SEQ ID NO: 191193
  derived and/or modified sequence opt5 from hemagglutinin__InfluenzaA__AEY69961

SEQ ID NO: 191196 - RNA, 1701 nt, Artificial Sequence
  derived and/or modified sequence opt5 from hemagglutinin__InfluenzaA__AEY69994
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauucgcagaucuaagaacuccuuuuucagccggcuuaauuggcugacacaucucaacuuuaaauauccugcccugaaugucaccaugcccaacaacgagcaguucgacaaacuuuacaucuggggcgugcaccauccugggacggauaaggaccagauuuuucuguaugcgcaagccucuggacgcaucacaguuuccaccaagagaagccagcagacagcuauuccgaauaucggcucccggccccgcgugagaaacaucccuucucggauuagcaucuacuggaccauugucaaacccggggauauccuccugauuaauuccaccggaaaccugaucgccccucgcggcuacuucaagaucagaagcgggaagucuuccauuaugcggagcgacgcucccaucggaaaauguaauucuggcugcauuacaccgaacggcagcaucccuaaugacaagcccuuucagaacgugaaucgcauuacguauggggccuguccuagauacgugaaacaaaacacccucaagcuggcgacaggaaugcggaauguccccgagaaacagacccgcggcaucuucggggccaucgcuggauuuauugaaaacggcugggaggggaugguugauggaugguauggcuucagacaccaaaauuccgaaggccgggggcaggccgcugaccuuaagucuacacaggccgccaucgaucagauuaacggaaaacugaauagacucaucggcaagaccaacgagaaguuccaccagauugagaaagaauuuagcgagguggaagggcgcauccaagaccuggagaaguacguggaagauacgaaaauugaccuuugguccuauaacgcugagcugcucgucgcgcuggagaaucagcauacaaucgaucugaccgacagcgaaaugaacaaacucuucgagaagaccaagaagcagcugcgggaaaaugccgaggauaugggaaacggcugcuuuaaaaucuaccacaagugugacaaugcuugcauugggucuaucagaaacggcacauaugaucaugacguguaccgcgacgaagcccuuaauaaccgguuccagauuaaaggaguugagcugaaguccggcuacaaagauugguuucucuggaucagcuucgccauuucuugcuuucugcuuuguguggcucugcucggguucaucaugugggccugccaaaagggaaauaucagauguaacauuugcaucuga

SEQ ID NO: 191197 - RNA, 1701 nt, Artificial Sequence; identical to SEQ ID NO: 191196
  derived and/or modified sequence opt5 from hemagglutinin__InfluenzaA__AEY70005

SEQ ID NO: 191198 - RNA, 1701 nt, Artificial Sequence; identical to SEQ ID NO: 186637
  derived and/or modified sequence opt5 from hemagglutinin__InfluenzaA__AEY70016

SEQ ID NO: 191199 - RNA, 1701 nt, Artificial Sequence
  derived and/or modified sequence opt5 from hemagglutinin__InfluenzaA__AEY70256
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuaugggaauuguuacccuuaugacgugcccgauuacgcuucccuccggucucugguugccagcuccggaacgcuugaguuuaacaaugaaucuuucaacuggaccggcgugacacagaauggcaccucuuccgcuugcauccgcagaagcaagaacagcuuuuucucccggcugaauuggcucacacaucugaacuuuaaauauccugcccuuaaugucaccaugcccaacaacgagcaguucgacaagcuguacauuuggggagugcaccauccugggacggauaaagaccagaucuuucucuaugcgcaagccagcggccgcauuacaguuucuaccaagagaucccagcagacagcuaucccgaauauugggagccggccccgcgugagaaacaucccuucccggaucucuauuuacuggaccaucgucaaacccggagauaugcugcugauuaauagcaccggcaaccucaucgccccucgcggguacuucaagauuagauccggaaagagcucuaucaugcgguccgacgcucccaucggcaaauguaauagcgagugcauuacaccgaacggcucuaucccuaaugacaagcccuuucagaacgugaaucgcauuacguauggggccuguccuagauacgugaaacaaaacacccugaaacuugcgacaggaaugcggaauguccccgaaaaacagacccgcggcaucuucggggccauugcuggauuuaucgagaacggcugggaagggaugguugauggaugguauggcuucagacaccagaauagcgagggccgggggcaagccgcugaccugaaguccacacaggccgccaucgaucagauuaacggaaaacucaauagacugaucggcaagaccaacgagaaguuccaccagauugaaaaagaguuuucugaaguggaggggcgcauccaagaccuugaaaaguacguggaggauacgaaaauugaccuguggagcuauaacgcugagcuccuggucgcgcuggaaaaucagcauacaaucgaucucaccgacuccgagaugaacaagcuguucgaaaagaccaagaagcagcuucgggagaaugccgaagauaugggaaacggcugcuuuaaaauuuaccacaagugugacaaugcuugcaucgggagcaucagaaacggcacauaugaucaugacguguaccgcgacgaggcccugaauaaccgguuccagauuaaaggaguugagcucaagucuggcuacaaagauuggauccuguggauuuccuuugccaucagcugcuuccuucuguguguggcucuccugggguuuauuaugugggccugccaaaagggaaauaucagauguaacaucugcauuuga

SEQ ID NO: 191200 - RNA, 1701 nt, Artificial Sequence; identical to SEQ ID NO: 186637
  derived and/or modified sequence opt5 from hemagglutinin__InfluenzaA__AEY70267

SEQ ID NO: 191201 - RNA, 1701 nt, Artificial Sequence; identical to SEQ ID NO: 186637
  derived and/or modified sequence opt5 from hemagglutinin__InfluenzaA__AEY70278

SEQ ID NO: 191202 - RNA, 1701 nt, Artificial Sequence; identical to SEQ ID NO: 186435
  derived and/or modified sequence opt5 from hemagglutinin__InfluenzaA__AEY70289

SEQ ID NO: 191203 - RNA, 1701 nt, Artificial Sequence; identical to SEQ ID NO: 186637
  derived and/or modified sequence opt5 from hemagglutinin__InfluenzaA__AEY70300

SEQ ID NO: 191204 - RNA, 1701 nt, Artificial Sequence; identical to SEQ ID NO: 186637
  derived and/or modified sequence opt5 from hemagglutinin__InfluenzaA__AEY70311

SEQ ID NO: 191205 - RNA, 1701 nt, Artificial Sequence; identical to SEQ ID NO: 186637
  derived and/or modified sequence opt5 from hemagglutinin__InfluenzaA__AEY70333

SEQ ID NO: 191206 - RNA, 1701 nt, Artificial Sequence; identical to SEQ ID NO: 191196
  derived and/or modified sequence opt5 from hemagglutinin__InfluenzaA__AEY70344

SEQ ID NO: 191207 - RNA, 1701 nt, Artificial Sequence; identical to SEQ ID NO: 188248
  derived and/or modified sequence opt5 from hemagglutinin__InfluenzaA__AEY70355

SEQ ID NO: 191208 - RNA, 1701 nt, Artificial Sequence; identical to SEQ ID NO: 186435
  derived and/or modified sequence opt5 from hemagglutinin__InfluenzaA__AEY70365

SEQ ID NO: 191209 - RNA, 1701 nt, Artificial Sequence; identical to SEQ ID NO: 186637
  derived and/or modified sequence opt5 from hemagglutinin__InfluenzaA__AEY70376

SEQ ID NO: 191210 - RNA, 1701 nt, Artificial Sequence
  derived and/or modified sequence opt5 from hemagglutinin__InfluenzaA__AFB18656
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccauccggccgaaaguccgcgaucaggagggaagaaugaauuacuauuggacccugguugaacccggcgacaagauuacauucgaggcuaccgggaaccugguggugccucgguacgccuuugcgauggaacgcgaugccggaagcggcaucauuaucuccgacacccccguccaugacugcaacacaacgugucaaaccccuaaaggcgcuaucaauacaagccuccccuuccagaacauucacccgaucaccauugggaagugcccuaaguaugugaaaucuacaaagcugagacuugccaccggacugcggaauguucccuccauccagagccgcggccucuuuggggcuauugccggauucaucgagggcggguggacgggaaugguggauggcugguacggcuaucaucaccagaacgaacaagggucuggauacgccgcugaccugaaaagcacacagaaugcgaucgauaagauuaccaacaaagucaauuccgugaucgagaagaugaacacccaguuuacagccguuggcaaggaguucaaucaccuugagaaaagaauugagaaccugaauaagaaaguggacgauggguuccucgacaucuggaccuacaacgcugaacugcugguccuccuggagaaugaacggacacuugauuaucaugacucuaacgugaagaaucuguacgagaaaguccgcaaccagcucaagaacaaugccaaggagauuggaaacggcuguuuugaguucuaucacaaaugcgauaauacguguauggaaagcgugaagaacgggaccuacgacuauccuaaauacuccgaagaggccaagcugaauagagaagagaucgauggcguuaaacuugagagcacacggaucuaucaaauucuggcuaucuacucuaccgccgcguccagccucgugcuggucgugucucugggagcuauuuccuuuuggaugugcagcaacggcucccuccagugccgcaucuguauuuga

SEQ ID NO: 191211 - RNA, 1701 nt, Artificial Sequence; identical to SEQ ID NO: 190074
  derived and/or modified sequence opt5 from hemagglutinin__InfluenzaA__AFB40597

SEQ ID NO: 191212 - RNA, 1701 nt, Artificial Sequence; identical to SEQ ID NO: 190074
  derived and/or modified sequence opt5 from hemagglutinin__InfluenzaA__AFB40598

SEQ ID NO: 191213 - RNA, 1701 nt, Artificial Sequence
  derived and/or modified sequence opt5 from hemagglutinin__InfluenzaA__AFB40599
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucugaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccaugacugcaauacaaccugucaaaccccuaaaggcgccaucaacacaucccugcccuuccagaauauucacccgaucacgauuggcaagugcccuaaguaugugaaaagcaccaaacuuagacuggcuacagggcuccggaacguucccucuauccagagccgcggacuguuuggcgccauugccggguucaucgagggaggcuggaccgggaugguggacggaugguacggcuaucaucaccagaaugaacaaggcuccggguacgcugcggaucuuaaaucuacacagaacgccaucgacaagauuaccaauaaagucaacagcgugaucgagaagaugaauacgcaguuuacagcuguuggaaaggaguucaaccaccuggaaaagagaauugagaaucucaacaagaaaguggaugacggcuuccuggauaucuggaccuacaaugccgaacugcucguccugcuugagaacgaacggacccuggacuaucaugauuccaaugugaagaaccucuacgagaaaguccgcagccagcugaagaacaaugccaaggagauugggaacggauguuuugaguucuaucacaaaugcgacaauacauguauggagucugugaagaacggcaccuacgauuauccuaaauacuccgaagaggcuaaacuuaauagagaagagaucgacgggguuaagcuggagagcacacggaucuaucaaauucucgccaucuacucuacgguggcguccagccugguccuggugguuucccucggcgcuauuucuuuuuggaugugcagcaacggaucccugcagugccgcaucuguauuuga

SEQ ID NO: 191214 - RNA, 1701 nt, Artificial Sequence; identical to SEQ ID NO: 186857
  derived and/or modified sequence opt5 from hemagglutinin__InfluenzaA__AFB40600

SEQ ID NO: 191215 - RNA, 1701 nt, Artificial Sequence
  derived and/or modified sequence opt5 from hemagglutinin__InfluenzaA__AFB40601
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccgaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgggcaggaaggaagaaugaauuacuauuggacccugguugagcccggcgauaaaauuacguucgaagccacagggaaccugguggugccucgguacgcguuugccauggagcgcaacgcuggaucuggcaucauuaucuccgacacccccguccaugauugcaauacaaccugucaaaccccuaagggcgccaucaacacaagccuccccuuccagaauauucacccgaucacgauugggaaaugcccuaaguaugugaagucuaccaaacugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaccuuaagagcacacagaacgccaucgaugagauuaccaauaaagucaacuccgugaucgaaaagaugaauacgcaguuuacagcuguuggcaaagaguucaaccaccuggaaaagagaauugagaaucugaacaagaaaguggacgauggguuccucgacaucuggaccuacaaugccgaacugcugguccuccuggagaacgagcggacccuugauuaucaugacagcaaugugaagaaccuguacgaaaaaguccgcucucagcucaagaacaaugccaaagagauuggaaacggcuguuuugaguucuaucacaagugcgauaauacauguauggaguccgugaagaacgggaccuacgacuauccuaaauacagcgaagaggcuaagcugaauagagaggaaaucgauggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 191216 - RNA, 1701 nt, Artificial Sequence; identical to SEQ ID NO: 185693
  derived and/or modified sequence opt5 from hemagglutinin__InfluenzaA__AFB40602

SEQ ID NO: 191217 - RNA, 1701 nt, Artificial Sequence; identical to SEQ ID NO: 186857
  derived and/or modified sequence opt5 from hemagglutinin__InfluenzaA__AFB40603

SEQ ID NO: 191218 - RNA, 1701 nt, Artificial Sequence
  derived and/or modified sequence opt5 from hemagglutinin__InfluenzaA__AFB40604
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaagaaggcaacagcuacccuaagcuguccaaaagcuauauuaaugacaaggggaaggaggugcuuguccuguggggaauccaccaucccccuaccacagccgaucaacagucccucuaccagaacgcugacaccuacguguucgugggcacgucuagauauagcaaaaaguuuaaaccggagauugccauccggcccaagguccgcgaucaggaagggagaaugaauuacuauuggacacugguugagccuggagacaaaauuaccuucgaagcuacaggcaaccugguggugccccgguacgccuuugcgauggagcgcaacgccggguccggaaucauuaucagcgauaccccuguccacgacugcaauaccacaugucaaacgcccaagggcgcuaucaacaccucucucccguuccagaauauucacccuaucacaauuggcaaaugccccaaguaugugaaguccaccaaacugagacuugccacagggcugcggaacguuccuagcauccagucucgcggacucuuuggcgcuauugccggguucaucgaaggaggcuggaccgggaugguggacggaugguacggcuaucaucaccagaaugagcaaggcagcggguacgccgcugaucugaaguccacgcagaacgcgaucgacaaaauuacaaauaaggucaacucugugaucgagaaaaugaauacccaguuuaccgccguugauaaggaguucaaccaccuugagaagagaauuggaaaucugaacaaaaagguggacgauggcuuccucgacaucuggacauacaaugcugaacugcugguccuccuggagaacgaacggacccuugauuaucaugacagcaaugugaaaaaccuguacgagaagguccgcaaccagcucaaaaauaacgccaaggagauugggaauggauguuuugaguucuaucacaagugcgauaacacauguauggaauccgugaaaaauggcacguacgacuaucccaaguacagcgaagaggccaaacugaacagagaagagaucgaugggguuaaacuugagucuacccggaucuaucaaauucuggcuaucuacuccacaguggccagcucucucguccuggugguuucccugggcgcgauuagcuuuuggaugugcuccaauggaucucuccagugccgcaucuguauuuga

SEQ ID NO: 191219 - RNA, 1701 nt, Artificial Sequence; identical to SEQ ID NO: 185693
  derived and/or modified sequence opt5 from hemagglutinin__InfluenzaA__AFB70138

SEQ ID NO: 191220 - RNA, 1701 nt, Artificial Sequence
  derived and/or modified sequence opt5 from hemagglutinin__InfluenzaA__AFB70145
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 191221 - RNA, 1701 nt, Artificial Sequence
  derived and/or modified sequence opt5 from hemagglutinin__InfluenzaA__AFB70154
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaauccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 191222 - RNA, 1701 nt, Artificial Sequence; identical to SEQ ID NO: 185693
  derived and/or modified sequence opt5 from hemagglutinin__InfluenzaA__AFB70156

SEQ ID NO: 191223 - RNA, 1701 nt, Artificial Sequence; identical to SEQ ID NO: 185693
  derived and/or modified sequence opt5 from hemagglutinin__InfluenzaA__AFB70158

SEQ ID NO: 191224 - RNA, 1701 nt, Artificial Sequence; identical to SEQ ID NO: 191220
  derived and/or modified sequence opt5 from hemagglutinin__InfluenzaA__AFB70160

SEQ ID NO: 191225 - RNA, 1701 nt, Artificial Sequence; identical to SEQ ID NO: 186887
  derived and/or modified sequence opt5 from hemagglutinin__InfluenzaA__AFB70162

SEQ ID NO: 191226 - RNA, 1701 nt, Artificial Sequence
  derived and/or modified sequence opt5 from hemagglutinin__InfluenzaA__AFB70167
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuaugcggccgaaaguccgcgaucaggaggggagaaugaauuacuauuggacccugguugaacccggagacaagaucacguucgaggccacaggcaaccugguggugccucgguacgcguuugccauggaacgcaacgcugggucuggaauuaucauuuccgauacccccguccaugacugcaauacaaccugucaaaccccuaaaggcgccaucaacacaagccuccccuuccagaauauccacccgauuacgaucggcaagugcccuaaguaugugaaaucuaccaagcugagacuugcuacagggcugcggaacguucccagcauucagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacgggguuaaacuugaaucuacacggaucuaucaaauccuggccauuuacuccacgguggcgagcucccucguccuggugguuucucugggcgcuaucagcuuuuggaugugcuccaacggaucucuccagugccgcauuuguaucuga

SEQ ID NO: 191227 - RNA, 1701 nt, Artificial Sequence; identical to SEQ ID NO: 185693
  derived and/or modified sequence opt5 from hemagglutinin__InfluenzaA__AFB70177

SEQ ID NO: 191228 - RNA, 1701 nt, Artificial Sequence; identical to SEQ ID NO: 186262
  derived and/or modified sequence opt5 from hemagglutinin__InfluenzaA__AFB70187

SEQ ID NO: 191229 - RNA, 1701 nt, Artificial Sequence; identical to SEQ ID NO: 186887
  derived and/or modified sequence opt5 from hemagglutinin__InfluenzaA__AFB70197

SEQ ID NO: 191230 - RNA, 1701 nt, Artificial Sequence; identical to SEQ ID NO: 185693
  derived and/or modified sequence opt5 from hemagglutinin__InfluenzaA__AFB70207

SEQ ID NO: 191231 - RNA, 1701 nt, Artificial Sequence; identical to SEQ ID NO: 185693
  derived and/or modified sequence opt5 from hemagglutinin__InfluenzaA__AFB70217

SEQ ID NO: 191232 - RNA, 1701 nt, Artificial Sequence; identical to SEQ ID NO: 185693
  derived and/or modified sequence opt5 from hemagglutinin__InfluenzaA__AFB70227

SEQ ID NO: 191233 - RNA, 1701 nt, Artificial Sequence
  derived and/or modified sequence opt5 from hemagglutinin__InfluenzaA__AFB70247
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaaggaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 191234 - RNA, 1701 nt, Artificial Sequence
  derived and/or modified sequence opt5 from hemagglutinin__InfluenzaA__AFB70257
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuugucgacuacgaagaacugcgggagcagcuuuccagcgugucuuccuucgaacgcuuugagauuuuccccaagaccagcucuuggccuaaucacgauuccaacaagggaguuacagccgcuuguccccaugccggcgcgaaaucuuuuuauaagaaucugaucuggcucgugaaaaagggcaacagcuacccuaaacuguccaagagcuauaucaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 191235 - RNA, 1701 nt, Artificial Sequence; identical to SEQ ID NO: 190100
  derived and/or modified sequence opt5 from hemagglutinin__InfluenzaA__AFB70267

SEQ ID NO: 191236 - RNA, 1701 nt, Artificial Sequence; identical to SEQ ID NO: 186163
  derived and/or modified sequence opt5 from hemagglutinin__InfluenzaA__AFB70277

SEQ ID NO: 191237 - RNA, 1701 nt, Artificial Sequence; identical to SEQ ID NO: 185693
  derived and/or modified sequence opt5 from hemagglutinin__InfluenzaA__AFB70287

SEQ ID NO: 191238 - RNA, 1701 nt, Artificial Sequence; identical to SEQ ID NO: 185693
  derived and/or modified sequence opt5 from hemagglutinin__InfluenzaA__AFB70297

SEQ ID NO: 191239 - RNA, 1701 nt, Artificial Sequence; identical to SEQ ID NO: 185693
  derived and/or modified sequence opt5 from hemagglutinin__InfluenzaA__AFB70307

SEQ ID NO: 191240 - RNA, 1701 nt, Artificial Sequence; identical to SEQ ID NO: 191220
  derived and/or modified sequence opt5 from hemagglutinin__InfluenzaA__AFB70317

SEQ ID NO: 191241 - RNA, 1701 nt, Artificial Sequence
  derived and/or modified sequence opt5 from hemagglutinin__InfluenzaA__AFB70327
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuuggcaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaagguccgcucucagcucaaaaacaaugccaaggagauuggaaacggcuguuuugaguucuaucacaagugcgacaauacauguauggaauccgugaaaaacgggaccuacgauuauccuaaguacagcgaagaggcuaaacugaauagagaagagaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 191242 - RNA, 1701 nt, Artificial Sequence; identical to SEQ ID NO: 185693
  derived and/or modified sequence opt5 from hemagglutinin__InfluenzaA__AFB70337

SEQ ID NO: 191243 - RNA, 1701 nt, Artificial Sequence; identical to SEQ ID NO: 187663
  derived and/or modified sequence opt5 from hemagglutinin__InfluenzaA__AFB70347

SEQ ID NO: 191244 - RNA, 1701 nt, Artificial Sequence; identical to SEQ ID NO: 185693
  derived and/or modified sequence opt5 from hemagglutinin__InfluenzaA__AFB70367

SEQ ID NO: 191245 - RNA, 1701 nt, Artificial Sequence; identical to SEQ ID NO: 185693
  derived and/or modified sequence opt5 from hemagglutinin__InfluenzaA__AFB70377

SEQ ID NO: 191246 - RNA, 1701 nt, Artificial Sequence; identical to SEQ ID NO: 186262
  derived and/or modified sequence opt5 from hemagglutinin__InfluenzaA__AFB70387

SEQ ID NO: 191247 - RNA, 1701 nt, Artificial Sequence; identical to SEQ ID NO: 185693
  derived and/or modified sequence opt5 from hemagglutinin__InfluenzaA__AFB70397

SEQ ID NO: 191248 - RNA, 1701 nt, Artificial Sequence; identical to SEQ ID NO: 185693
  derived and/or modified sequence opt5 from hemagglutinin__InfluenzaA__AFB70407

SEQ ID NO: 191249 - RNA, 1701 nt, Artificial Sequence
  derived and/or modified sequence opt5 from hemagglutinin__InfluenzaA__AFB77618
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaauccuuuuauaagaaccugauuuggcucgugaaaaagggcaauucuuacccuaaacuguccaagagcuauaucaacgauaaggggaaagaaguucuugugcuguggggcauucaccaccccaccacaaccggagaccaacagucccucuaccagaaugccgauggguacgucuucgugggaacgacaagauauucuaagaaauuuaagccugagaucggcauucggccgaaagugaaggaccaggaggggcgcaugaacuacuauuggacccuggucgaacccggagauaaaaucacauucgaggcuaccggcaaccugguugugccuagauacgccuuugcuauggaacggaaugccggcagcgggauuaucaucuccgacacccccgugcaugauugcaacacaacgugucaaaccccuaagggagcgauuaauacaagccuccccuuccagaacauccacccgauuaccaucggcaagugcccuaaauaugucaagucuacaaaacugcgccuugccaccgggcugagaaaugugcccuccauucagagccggggacucuuuggcgcuaucgccggguucaucgagggaggcuggacgggcaugguugacgggugguacggauaucaucaccagaacgaacaaggcucuggguacgcugccgaccuuaagagcacacagaaugccauugauaaaaucaccaacaaggugaauagcgucauugagaagaugaacacccaguuuacagcugugggaaaagaguucaaucaccuugaaaagcgcaucgagaaccugaauaaaaagguugacgauggcuuccucgacauuuggaccuacaacgcggaacugcuggugcuccuggagaaugaaagaacacuugauuaucaugacucuaacgucaaaaaccuguacgagaaggugcggaaucagcucaagaacaaugccaaagagaucgggaacggcuguuuugaguucuaucacaagugcgauaauacguguauggagagcgucaaaaacggaaccuacgacuauccuaaguacuccgaagaggcuaaacugaaucgcgaagagaucgauggcgugaagcuggagagcacaagaauuuaucaaauccuggccauuuacucuaccguugccuccagccucgugauggucgugucucugggggcuaucuccuuuuggaugugcagcaacggaucccugcagugccggauuuguaucuga

SEQ ID NO: 191250 - RNA, 1701 nt, Artificial Sequence; identical to SEQ ID NO: 189891
  derived and/or modified sequence opt5 from hemagglutinin__InfluenzaA__AFB77619

SEQ ID NO: 191251 - RNA, 1701 nt, Artificial Sequence; identical to SEQ ID NO: 189891
  derived and/or modified sequence opt5 from hemagglutinin__InfluenzaA__AFB77620

SEQ ID NO: 191252 - RNA, 1701 nt, Artificial Sequence
  derived and/or modified sequence opt5 from hemagglutinin__InfluenzaA__AFB77621
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaccugguggugccucgguacgccuuugcgauggaacgcaaugccgggagcggaaucauuaucucugacacccccguccaugauugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauauccccucuauucagagccgcggacucuuuggcgcuaucgccggguucaucgagggaggcuggaccgggaugguugacggaugguacggcuaucaucaccagaacgaacaaggcuccggguacgccgcugaccugaaaucuacgcagaaugcgauugauaagaucacaaacaaagugaauagcgucauugagaagaugaacacccaguuuaccgccgugggaaaggaguucaaucaccuugagaaaagaaucgagaaccugaauaagaaaguugacgauggcuuccucgacauuuggacauacaacgcugaacugcuggugcuccuggagaaugaacggacccuugauuaucaugacuccaacgucaagaaccuguacgagaaagugcgcaaucagcucaagaacaaugccaaggagaucgggaacggauguuuugaguucuaucacaaaugcgauaauacauguauggaaagcgucaagaacggcacguacgacuauccuaaauacucugaagaggccaagcugaauagagaagagaucgauggggugaaacuugaguccacccggauuuaucaaauccuggcuauuuacagcacaguugccucuucccucgugcuggucgugagccugggcgcgaucuccuuuuggaugugcucuaacggaagccuccagugccgcauuuguaucuga

SEQ ID NO: 191253 - RNA, 1701 nt, Artificial Sequence
  derived and/or modified sequence opt5 from hemagglutinin__InfluenzaA__AFB77622
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgaccccaauaagggagugacagccgcuuguccucaugccggcgcgaaauccuuuuauaagaaccugaucuggcucguuaaaaagggcaauagcuaccccaaacugucuaaguccuauauuaacgauaaggggaaagaagugcuuguccuguggggaauccaccacccuagcaccacagccgaccaacagucccucuaccagaaugcugaugccuacguguucgugggcaccucuagauauagcaagaaauuuaagccggagauugcuauccggcccaaaguccgcgaccaggaggggagaaugaacuacuauuggacgcugguugaaccuggagauaagauuacauucgaggccaccggcaaccugguggugccccgguacgcguuugccauggaacgcaaugcuggguccggaaucauuaucagcgacacaccuguccaugauugcaacaccaccugucaaacacccaaaggcgccaucaauacgucucucccguuccagaacauucacccuaucaccauuggcaagugccccaaguaugugaaauccacaaagcugagacuugcuaccgggcugcggaauguuccuagcauccagucucgcggacucuuuggcgccauugccggguucaucgagggaggcuggacagggaugguggacggaugguacggcuaucaucaccagaacgaacaaggcagcggguacgcugcggaccugaaauccacccagaaugccaucgauaagauuacgaacaaagucaauucugugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacagcaacgugaagaaccuguacgagaaaguccgcaaucagcucaagaacaaugccaaggagauugggaacggauguuuugaguucuaucacaaaugcgauaauaccuguauggaauccgugaagaacggcacauacgacuaucccaaauacagcgaagaggcuaagcugaauagagaagagaucgaugggguuaaacuugagucuacgcggaucuaucaaauucuggccaucuacuccaccguggcgagcucucucguccuggugguuucccugggcgcuauuagcuuuuggaugugcuccaacggaucucuccagugccgcaucuguauuuga

SEQ ID NO: 191254 - RNA, 1701 nt, Artificial Sequence; identical to SEQ ID NO: 189891
  derived and/or modified sequence opt5 from hemagglutinin__InfluenzaA__AFB77623

SEQ ID NO: 191255 - RNA, 1701 nt, Artificial Sequence; identical to SEQ ID NO: 189891
  derived and/or modified sequence opt5 from hemagglutinin__InfluenzaA__AFB77624

SEQ ID NO: 191256 - RNA, 1701 nt, Artificial Sequence
  derived and/or modified sequence opt5 from hemagglutinin__InfluenzaA__AFB77625
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaccugguggugccucgguacgccuuugcgauggaacgcaaugccgggagcggaaucauuaucucugacacccccguccaugauugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauguucccucuauccagagccgcggacucuuuggcgcuauugccggguucaucgagggaggcuggaccgggaugguggacggaugguacggcuaucaucaccagaacgaacaaggcuccggguacgccgcugaccugaaaucuacgcagaaugcgaucgauaagauuacaaacaaagucaauagcgugaucgagaagaugaacacccaguuuaccgccguuggaaaggaguucaaucaccuugagaaaagaauugagaaccugaauaagaaaguggacgauggcuuccucgacaucuggacauacaacgcugaacugcugguccuccuggagaaugaacggacccuugauuaucaugacuccaacgugaagaaccuguacgagaaaguccgcaaucagcucaagaacaaugccaaggagauugggaacggauguuuugaguucuaucacaaaugcgauaauacauguauggaaagcgugaagaacggcacguacgacuauccuaaauacucugaagaggccaagcugaauagagaagagaucgaugggguuaaacuugaguccacccggaucuaucaaauucuggcuaucuacagcacaguggccucuucccucguccuggugguuagccugggcgcgauuuccuuuuggaugugcucuaacggaagccuccagugccgcaucuguauuuga

SEQ ID NO: 191257 - RNA, 1701 nt, Artificial Sequence
  derived and/or modified sequence opt5 from hemagglutinin__InfluenzaA__AFB77627
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuucagcaagaccucuuccuggcccaaccacgacagcaauaagggagugacagccgcuuguccucaugccggcgcgaaaucuuuuuauaagaaccugaucuggcucguuaaaaagggcaauuccuaccccaaacugagcaaguccuauauuaacgauaaggggaaagaagugcuuguccuguggggaauccaccacccuucuaccacagccgaccaacagagccucuaccagaaugcugaugccuacguguucgugggcaccuccagauauagcaagaaauuuaagcccgagauugcuauccggccuaaaguccgcgaccaggaggggagaaugaacuacuauuggacgcugguugaaccgggagauaagauuacauucgaggccaccggcaaccugguggugccccgguacgcguuugccauggaacgcaaugcugggucuggaaucauuaucuccgacacaccuguccaugauugcaacaccaccugucaaacacccaaaggcgccaucaauacgagccucccuuuccagaacauucaccccaucaccauuggcaagugcccgaaguaugugaaaucuacaaagcugagacuugcuaccgggcugcggaauguuccuagcauccagucccgcggacucuuuggcgccauugccggguucaucgagggaggcuggacagggaugguggacggaugguacggcuaucaucaccagaacgaacaaggcucuggguacgcugcggaccugaaaagcacccagaaugccaucgauaagauuacgaacaaagucaauuccgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacagcaacgugaagaaccuguacgagaaaguccgcaaucagcucaagaacaaugccaaggagauugggaacggauguuuugaguucuaucacaaaugcgauaauaccuguauggaaucugugaagaacggcacauacgacuaucccaaauacuccgaagaggcuaagcugaauagagaagagaucgaugggguuaaacuugagagcacgcggaucuaucaaauucuggccaucuacucuaccguggcguccagccucguccuggugguuucccugggcgcuauuucuuuuuggaugugcagcaacggaucccuccagugccgcaucuguauuuga

SEQ ID NO: 191258 - RNA, 1701 nt, Artificial Sequence; identical to SEQ ID NO: 189891
  derived and/or modified sequence opt5 from hemagglutinin__InfluenzaA__AFB77628

SEQ ID NO: 191259 - RNA, 1701 nt, Artificial Sequence
  derived and/or modified sequence opt5 from hemagglutinin__InfluenzaA__AFB77629
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaccugguggugccucgguacgccuuugcgauggaacgcaaugccgggagcggaaucauuaucucugacacccccguccaugauugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauguucccucuauccagagccgcggacucuuuggcgcuauugccggguucaucgagggaggcuggaccgggaugguggacggaugguacggcuaucaucaccagaacgaacaaggcuccggguacgccgcugaccugaaaucuacgcagaaugcgaucgauaagauuacaaacaaagucaauagcgugaucgagaagaugaacacccaguuuaccgccguuggaaaggaguucaaucaccuugagaaaagaauugagaaccugaauaagaaaguggacgauggcuuccucgacaucuggacauacaacgaggaacugcugguccuccuggaaaaugagcggacccuugauuaucaugacuccaacgugaagaaccuguacgagaaaguccgcaaucagcucaagaacaaugcuaaggaaauugggaacggauguuuugaguucuaucacaaaugcgauaauacauguauggaaagcgugaagaacggcacguacgacuauccuaaauacucugaggaagccaagcugaauagagaggagaucgaugggguuaaacuugaauccacccggaucuaucaaauucuggccaucuacagcacaguggcuucuucccucguccuggugguuagccugggcgccauuuccuuuuggaugugcucuaacggaagccuccagugccgcaucuguauuuga

SEQ ID NO: 191260 - RNA, 1701 nt, Artificial Sequence
  derived and/or modified sequence opt5 from hemagglutinin__InfluenzaA__AFB77630
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgaauccaauaagggagugacagccgcuuguccccaugccggcgcgaaaucuuuuuauaagaaccugaucuggcucguuaaaaagggcaauagcuacccuaaacuguccaagagcuauauuaacgacaaggggaaagaggugcuuguccuguggggaauccaccaccccuccaccacagccgaucaacagucucucuaccagaaugcugacgccuacguguucgugggcaccagcagauauuccaagaaauuuaagccugagauugcuauccggccgaaaguccgcgaucaggaagggagaaugaacuacuauuggacgcugguugagcccggagacaagauuacauucgaagccaccggcaaccugguggugccucgguacgcguuugccauggagcgcaaugcugggagcggaaucauuaucucugauacacccguccaugacugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgaaggaggcuggacagggaugguggauggaugguacggcuaucaucaccagaacgagcaaggcuccggguacgcugcggaccugaaaucuacccagaaugccaucgacaagauuacgaacaaagucaauagcgugaucgagaagaugaacacacaguuuaccgcuguuggaaaggaguucaaucaccuugagaaaagaauugaaaaccugaauaagaaaguggaugacggcuuccucgauaucuggaccuacaacgccgagcugcugguccuccuggaaaaugagcggacacuugacuaucaugauuccaacgugaagaaccuguacgagaaaguccgcaaucagcucaagaacaaugccaaggaaauugggaacggauguuuugaguucuaucacaaaugcgacaauaccuguauggaaagcgugaagaacggcacauacgauuauccuaaauacucugaggaagcuaagcugaauagagaggagaucgacgggguuaaacuugaauccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 191261 - RNA, 1701 nt, Artificial Sequence
  derived and/or modified sequence opt5 from hemagglutinin__InfluenzaA__AFB77631
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauuaauuacgaagaacugcgggagcagcuuuccagcgucucuuccuucgaacgcuuugagaucuuccccaagacaagcucuuggccuaaccacgacuccaauaagggagugaccgcugccuguccccaugcuggcgccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaccugguggugccucgguacgccuuugcgauggaacgcaaugccgggagcggaaucauuaucucugacacccccguccaugauugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauguucccucuauccagagccgcggacucuuuggcgcuauugccggguucaucgagggaggcuggaccgggaugguggacggaugguacggcuaucaucaccagaacgaacaaggcuccggguacgccgcugaccugaaaucuacgcagaaugcgaucgauaagauuacaaacaaagucaauagcgugaucgagaagaugaacacccaguuuaccgccguuggaaaggaguucaaucaccuugagaaaagaauugagaaccugaauaagaaaguggacgauggcuuccucgacaucuggacauacaacgcugaacugcugguccuccuggagaaugaacggacccuugauuaucaugacuccaacgugaagaaccuguacgagaaaguccgcaaucagcucaagacaaacgccaaggagauugggaauggauguuuugaguucuaucacaaaugcgauaacacguguauggaaagcgugaagaauggcaccuacgacuauccuaaauacucugaagaggccaagcugaacagagaagagaucgaugggguuaaacuugaguccacacggaucuaucaaauucuggcuaucuacagcaccguggccucuucccucguccuggugguuagccugggcgcgauuuccuuuuggaugugcucuaauggaagccuccagugccgcaucuguauuuga

SEQ ID NO: 191262 - RNA, 1701 nt, Artificial Sequence
  derived and/or modified sequence opt5 from hemagglutinin__InfluenzaA__AFB77632
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucacaaccgccagcuccuggucuuacaucguggagacgagcuccucugacaacgggaccugcuauccgggcgauuuuauuaauuacgaagaacugcgggagcagcuuagcuccgucagcucuuucgaacgcuuugagaucuuccccaagacauccagcuggccuaaccacgacucuaauaagggagugaccgccgcuuguccccaugccggcgcgaaauccuuuuauaagaaccugaucuggcucguuaaaaagggcaauagcuacccuaaacugucuaaguccuauauuaacgauaaggggaaagaagugcuuguccuguggggaauccaccaccccagcacaaccgccgaccaacagucccucuaccagaaugcugaugccuacguguucgugggcacgucuagauauagcaagaaauuuaagccugagauugcuauccggccgaaaguccgcgaccaggaggggagaaugaacuacuauuggacacugguugaacccggagauaagauuaccuucgaggccacaggcaaccugguggugccucgguacgcguuugccauggaacgcaaugcuggguccggaaucauuaucagcgacacccccguccaugauugcaacaccacaugucaaacgccuaaaggcgccaucaauaccucucuccccuuccagaacauucacccgaucacaauuggcaagugcccuaaguaugugaaauccaccaagcugagacuugcuacagggcugcggaauguucccagcauccagucucgcggacucuuuggcgccauugccggguucaucgagggaggcuggaccgggaugguggacggaugguacggcuaucaucaccagaacgaacaaggcagcggguacgcugcggaccugaaauccacgcagaaugccaucgauaagauuacaaacaaagucaauucugugaucgagaagaugaacacccaguuuaccgcuguuggaaaggaguucaaucaccuugagaaaagaauugagaaccugaauaagaaaguggacgauggcuuccucgacaucuggacauacaacgccgaacugcugguccuccuggagaaugaacggacccuugauuaucaugacagcaacgugaagaaccuguacgagaaaguccgcaaucagcucaagaacaaugccaaggagauugggaacggauguuuugaguucuaucacaaaugcgauaauacauguauggaauccgugaagaacggcacguacgacuauccuaaauacagcgaagaggcuaagcugaauagagaagagaucgaugggguuaaacuugagucuacccggaucuaucaaauucuggccaucuacuccacaguggcgagcucucucguccuggugguuucccugggcgcuauuagcuuuuggaugugcuccaacggaucucuccagugcaagaucuguauuuga

SEQ ID NO: 191263 - RNA, 1701 nt, Artificial Sequence
  derived and/or modified sequence opt5 from hemagglutinin__InfluenzaA__AFB77633
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguagccaugccggcgcgaaaucuuuuuauaagaaccugaucuggcucguuaaaaagggcaauuccuaccccaaacugagcaaguccuauauuaacgauaaggggaaagaagugcuuguccuguggggaauccaccacccuucuaccacagccgaccaacagagccucuaccagaaugcugaugccuacguguucgugggcaccuccagauauagcaagaaauuuaagcccgagauugcuauccggccuaaaguccgcgaccaggaggggagaaugaacuacuauuggacgcugguugaaccgggagauaagauuacauucgaggccaccggcaaccugguggugccccgguacgcguuugccauggaacgcaaugcugggucuggaaucauuaucuccgacacaccuguccaugauugcaacaccaccugucaaacacccaaaggcgccaucaauacgagccucccuuuccagaacauucaccccaucaccauuggcaagugcccgaaguaugugaaaucuacaaagcugagacuugcuaccgggcugcggaauguuccuagcauccagucccgcggacucuuuggcgccauugccggguucaucgagggaggcuggacagggaugguggacggaugguacggcuaucaucaccagaacgaacaaggcucuggguacgcugcggaccugaaaagcacccagaaugccaucgauaagauuacgaacaaagucaauuccgugaucgagaagaugaacacacaguuuaccgcuguuggaaaggaguucaaucaccuugaaaagagaauugagaaccugaauaagaaaguggacgauggcuuccucgacaucuggaccuacaacgccgaacugcugguccuccuggagaaugaacggacacuugauuaucaugacagcaacgugaagaaccuguacgagaaagucaagaaucagcucaagaacaaugccaaagagauugggaacggauguuuugaguucuaucacaagugcgauaauacccccaucaaaaacgugaagaauggcacauacgacuauccuaaauacucugaggaagcuaagcugaaccgcgaggaaaucgaugggguuaaacuugaguccacgagaauuuaucaaauccuggccauuuacagcaccguggcgucuucccucguccuggugguuagccugggcgcuaucuccuuuuggauguguucuaauggaagccuccagugccggauuugcaucuga

SEQ ID NO: 191264 - RNA, 1701 nt, Artificial Sequence
  derived and/or modified sequence opt5 from hemagglutinin__InfluenzaA__AFB77634
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagagaagauuacauucgaagccaccggcaaccugguggugccucgguacgcguuugccauggagcgcaaugcugggagcggaaucauuaucucugauacacccguccaugacugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgaaggaggcuggacagggaugguggauggaugguacggcuaucaucaccagaacgagcaaggcuccggguacgcugcggaccugaaaucuacccagaaugccaucgacaagauuacgaacaaagucaauagcgugaucgagaagaugaacacacaguuuaccgcuguuggaaaggaguucaaucaccuugagaaaagaauugaaaaccugaauaagaaaguggaugacggcuuccucgauaucuggaccuacaacgccgagcugcugguccuccuggaaaaugagcggacacuugacuaucaugauuccaacgugaagaaccuguacgagaaaguccgcaaucagcucaagaacaaugccaaggaaauugggaacggauguuuugaguucuaucacaaaugcgacaauaccuguauggaaagcgugaagaacggcacauacgauuauccuaaauacucugaggaagcuaagcugaauagagaggagaucgacgggguuaaacuugaauccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 191265 - RNA, 1701 nt, Artificial Sequence
  derived and/or modified sequence opt5 from hemagglutinin__InfluenzaA__AFB77635
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccccguggucuuacaucguggagaccagcuccucugacaacggcacgugcuaucccggggauuuuauuaauuacgaagaacugcgggagcagcuuagcuccgucagcucuuucgaacgcuuugagaucuucccuaagaccuccagcuggcccaaccacgacucuaauaagggagugacagccgcuuguccucaugccggcgcgaaauccuuuuauaagaaccugaucuggcucguuaaaaagggcaauagcuaccccaaacugucuaaguccuauauuaacgauaaggggaaagaagugcuuguccuguggggaauccaccacccuagcaccacagccgaccaacagucccucuaccagaaugcugaugccuacguguucgugggcaccucuagauauagcaagaaauuuaagccggagauugcuauccggcccaaaguccgcgaccaggaggggagaaugaacuacuauuggacgcugguugaaccuggagauaagauuacauucgaggccaccggcaaccugguggugccccgguacgcguuugccauggaacgcaaugcuggguccggaaucauuaucagcgacacaccuguccaugauugcaacaccaccugucaaacacccaaaggcgccaucaauacgucucucccguuccagaacauucacccuaucaccauuggcaagugccccaaguaugugaaauccacaaagcugagacuugcuaccgggcugcggaauguuccuagcauccagucucgcggacucuuuggcgccauugccggguucaucgagggaggcuggacagggaugguggacggaugguacggcuaucaucaccagaacgaacaaggcagcggguacgcugcggaccugaaauccacccagaaugccaucgauaagauuacgaacaaagucaauucugugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacagcaacgugaagaaccuguacgagaaaguccgcaaucagcucaagaacaaugccaaggagauugggaacggauguuuugaguucuaucacaaaugcgauaauaccuguauggaauccgugaagaacggcacauacgacuaucccaaauacagcgaagaggcuaagcugaauagagaagagaucgaugggguuaaacuugagucuacgcggaucuaucaaauucuggccaucuacuccaccguggcgagcucucucguccuggugguuucccugggcgcuauuagcuuuuggaugugcuccaacggaucucuccagugccgcaucuguauuuga

SEQ ID NO: 191266 - RNA, 1701 nt, Artificial Sequence
  derived and/or modified sequence opt5 from hemagglutinin__InfluenzaA__AFB77636
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaagcugggagcggaaucauuaucucugacacacccguccaugauugcaauaccaccugucaaacaccuaagggcgccaucaacacgucccuccccuuccagaauauucacccgaucaccauuggcaagugcccuaaauauguuaagagcacaaaacugagacuugcuaccgggcugcggaacgugcccucuauccagagccgcggacucuuuggcgccauugccggguucaucgagggaggcuggacagggaugguggacggaugguacggcuaucaucaccagaaugaacaaggcuccggguacgcugcggaccugaagucuacccagaacgccaucgauaaaauuacgaauaaggucaacagcgugaucgagaagaugaauacacaguuuaccgcuguuggaaaagaguucaaccaccuugaaaagagaauugagaaucugaacaaaaagguggacgauggcuuccucgacaucuggaccuacaaugccgaacugcugguccuccuggagaacgaacggacacuugauuaucaugacuccaaugugaaaaaccuguacgagaagguccgcaaccagcucaagaauaacgccaaagagauugggaauggauguuuugaguucuaucacaagugcgauaacaccuguauggagagcgugaaaaauggcacauacgacuauccuaaguacucugaagaggcuaaacugaacagagaagagaucgaugggguuaaacuugaguccacgcggaucuaucaaauucuggccaucuacagcaccguggcgucuucccucgucauggugguuagccugggcgcuauuuccuuuuggaugugcucuaauggaagccugcagugccgcaucuguauuuga

SEQ ID NO: 191267 - RNA, 1701 nt, Artificial Sequence
  derived and/or modified sequence opt5 from hemagglutinin__InfluenzaA__AFB77637
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaagggcgcgaccaggagggaagaaugaacuacuauuggacgcuggucgaacccggcgauaagauuacauucgaggccaccgggaaccugguugugccucgguacgcguuugccauggaacgcaaugcuggaagcggcaucauuaucucugacacacccgugcaugauugcaacaccaccugucaaacaccuaaaggcgccaucaauacgucccuccccuuccagaacauucacccgaucaccauugggaagugcccuaaguaugucaaaagcacaaagcugagacuugcuaccggacugcggaaugugcccucuauccagagccgcggccucuuuggggccauugccggauucaucgagggcggguggacaggaaugguugacggcugguacggcuaucaucaccagaacgaacaaggguccggauacgcugcggaccugaaaucuacccagaaugccaucgauaagauuacgaacaaagugaauagcgucaucgagaagaugaacacacaguuuaccgcugugggcaaggaguucaaucaccuugagaaaagaauugagaaccugaauaagaaaguugacgauggguuccucgacaucuggaccuacaacgccgaacugcuggugcuccuggagaaugaacggacacuugauuaucaugacuccaacgucaagaaccuguacgagaaagugcgcaaucagcucaagaacaaugccaaggagauuggaaacggcuguuuugaguucuaucacaaaugcgauaauaccuguauggaaagcgucaagaacgggacauacgacuauccuaaauacucugaagaggcuaagcugaauagagaagagaucgauggcgugaaacuugaguccacgcggaucuaucaaauucuggccaucuacagcaccguugcgucuucccucgugcuggucgugagccugggagcuauuuccuuuuggaugugcucuaacggcagccuccagugccgcaucuguauuuga

SEQ ID NO: 191268 - RNA, 1701 nt, Artificial Sequence
  derived and/or modified sequence opt5 from hemagglutinin__InfluenzaA__AFB77638
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaaguucuauauuaacgauaaggggaaagaagugcuuguccuguggggaauccaccaccccagcaccacagccgaccaacagucccucuaccagaaugcugaugccuacguguuugugggcaccucuagauauagcaagaaauucaagccugagauugcuauccggccgaaaguccgcgaccaggaggggagaaugaacuacuauuggacgcugguugaacccggagauaagauuacauuugaggccaccggcaaccugguggugccucgguacgcguucgccauggaacgcaaugcuggguccggaaucauuaucagcgacacacccguccaugauugcaacaccaccugucaaacaccuaaaggcgccaucaauacgucucuccccuuucagaacauucacccgaucaccauuggcaagugcccuaaguaugugaaauccacaaagcugagacuugcuaccgggcugcggaauguucccagcauccagucucgcggacucuucggcgccauugccggguuuaucgagggaggcuggacagggaugguggacggaugguacggcuaucaucaccagaacgaacaaggcagcggguacgcugcggaccugaaauccacccagaaugccaucgauaagauuacgaacaaagucaauucugugaucgagaagaugaacacacaguucaccgcuguuggaaaggaguucaaucaccuugagaaaagaauugagaaccugaauaagaaaguggacgauggcuuucucgacaucuggaccuacaacgccgaacugcugguccuccuggagaaugaacggacacuugauuaucaugacagcaacgugaagaaccuguacgagaaaguccgcaaucagcucaagaacaaugccaaggagauugggaacggauguuucgaauuuuaucacaaaugcgauaauaccuguauggaguccgugaagaacggcacauacgacuauccuaaauacagcgaagaggcuaagcugaauagagaagagaucgaugggguuaaacuugagucuacgcggaucuaucaaauucuggccaucuacuccaccguggcgagcucucucguccuggugguuucccugggcgcuauuagcuucuggaugugcuccaacggaucucuccagugccgcaucuguauuuga

SEQ ID NO: 191269 - RNA, 1701 nt, Artificial Sequence; identical to SEQ ID NO: 189891
  derived and/or modified sequence opt5 from hemagglutinin__InfluenzaA__AFB77639

SEQ ID NO: 191270 - RNA, 1701 nt, Artificial Sequence
  derived and/or modified sequence opt5 from hemagglutinin__InfluenzaA__AFB77640
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagggccucuaccagaaugcugaugccuacguguucguggggaccucuagauauagcaagaaauuuaagccugagauugcuauccggccgaaaguccgcgaccaggagggaagaaugaacuacuauuggacgcugguugaacccggcgauaagauuacauucgaggccaccgggaaccugguggugccucgguacgcguuugccauggaacgcaaugcuggauccggcaucauuaucagcgacacacccguccaugauugcaacaccaccugucaaacaccuaaaggcgccaucaauacgucucuccccuuccagaacauucacccgaucaccauugggaagugcccuaaguaugugaaauccacaaagcugagacuugcuaccggacugcggaauguucccagcauccagucucgcggccucuuuggggccauugccggauucaucgagggcggguggacaggaaugguggacggcugguacggcuaucaucaccagaacgaacaagggagcggauacgcugcggaccugaaauccacccagaaugccaucgauaagauuacgaacaaagucaauucugugaucgagaagaugaacacacaguuuaccgcuguuggcaaggaguucaaucaccuugagaaaagaauugagaaccugaauaagaaaguggacgauggguuccucgacaucuggaccuacaacgccgaacugcugguccuccuggagaaugaacggacacuugauuaucaugacagcaacgugaagaaccuguacgagaaaguccgcaaucagcucaagaacaaugccaaggagauuggaaacggcuguuuugaguucuaucacaaaugcgauaauaccuguauggaauccgugaagaacgggacauacgacuauccuaaauacagcgaagaggcuaagcugaauagagaagagaucgauggcguuaaacuugagucuacgcggaucuaucaaauucuggccaucuacuccaccguggcgagcucucucguccuggugguuucccugggagcuauuagcuuuuggaugugcuccaacggcucucuccagugccgcaucuguauuuga

SEQ ID NO: 191271 - RNA, 1701 nt, Artificial Sequence
  derived and/or modified sequence opt5 from hemagglutinin__InfluenzaA__AFB77641
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcgauaauauguguauggaaagcgugaagaacggcaccuacgacuauccuaaauacucugaagaggcuaagcugaauagagaagagaucgaugggguuaaacuugaguccacacggaucuaucaaauucuggccaucuacagcacgguggcgucuucccucguccuggugguuagccugggcgcuauuuccuuuuggaugugcucuaacggaagccuccagugccgcaucuguauuuga

SEQ ID NO: 191272 - RNA, 1701 nt, Artificial Sequence; identical to SEQ ID NO: 189891
  derived and/or modified sequence opt5 from hemagglutinin__InfluenzaA__AFB77642

SEQ ID NO: 191273 - RNA, 1701 nt, Artificial Sequence
  derived and/or modified sequence opt5 from hemagglutinin__InfluenzaA__AFB77643
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagccuagcucuuggcccaaccacgacuccaauaagggagugaccgccgcuuguccucaugccggcgcgaaaucuuuuuauaagaaccugaucuggcucguuaaaaagggcaauagcuaccccaaacuguccaagagcuauauuaacgauaaggggaaagaagugcuuguccuguggggaauccaccacccuuccacaaccgccgaccaacagucucucuaccagaaugcugaugccuacguguucgugggcacaagcagauauuccaagaaauuuaagccggagauugcuauccggcccaaaguccgcgaccaggaggggagaaugaacuacuauuggacccugguugaaccuggagauaagauuacguucgaggccacaggcaaccugguggugccccgguacgcguuugccauggaacgcaaugcugggagcggaaucauuaucucugacaccccuguccaugauugcaacacaaccugucaaacccccaaaggcgccaucaauacaucccucccguuccagaacauucacccuaucacgauuggcaagugccccaaguaugugaaaagcaccaagcugagacuugcuacagggcugcggaauguuccuucuauccagagccgcggacucuuuggcgccauugccggguucaucgagggaggcuggaccgggaugguggacggaugguacggcuaucaucaccagaacgaacaaggcuccggguacgcugcggaccugaaaucuacacagaaugccaucgauaagauuaccaacaaagucaauagcgugaucgagaagaugaacacgcaguuuacagcuguuggaaaggaguucaaucaccuugagaaaagaauugagaaccugaauaagaaaguggacgauggcuuccucgacaucuggaccuacaacgccgaacugcugguccuccuggagaaugaacggacccuugauuaucaugacuccaacgugaagaaccuguacgagaaaguccgcaaucagcucaagaacaaugccaaggagauugggaacggauguuuugaguucuaucacaaaugcgauaauacauguauggaaagcgugaagaacggcaccuacgacgauacaaaagacucugaagaggcuaagcugaauagagaagagaucgaugggguuaaacuugaguccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 191274 - RNA, 1701 nt, Artificial Sequence
  derived and/or modified sequence opt5 from hemagglutinin__InfluenzaA__AFB77691
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgaaaagcuguacauuuggggcgugcaccauccugggacggacaaagaucagaucuuucucuaugcgcaagccagcggacgcauuacaguuucuaccaagagaucccagcaggcugugaucccgaauauuggcagccggcugcgcgucagaaacauccccucccggaucucuauuuacuggacaaucgugaaaccuggggacauucugcucaucaauagcaccggaaaccugaaugcuccccgcggcuacuucaagauuagauccgggaaaagcucuaucaugcgguccgaugccccuaucggaaaguguaacagcgagugcauuacccccaauggcucuaucccgaacgacaagccuuuucagaaugugaaccgcauuacauauggcgccugucccagauacgucaaacaaaauacgcuuaagcuggcgaccgggaugcggaacguuccugaaaaacagacacgcggaaucuucggcgccauugcuggguuuaucgagaauggaugggagggcaugguggacgggugguauggauucagacaccagaacagcgaaggccggggccaagccgcugaucucaaguccacccaggccgccaucgaccagauuaacgggaaacugaauagacuuaucggaaagacaaacgagaaauuccaccagauugaaaaggaguuuucugaaguggagggccgcauccaagaucuggagaaguacgucgaagacaccaaaauugaucucuggagcuauaaugcugagcugcugguggcgcucgaaaaccagcauacgaucgaccugacagauuccgagaugaauaaacuuuucgaaaagaccaagaaccagcugcgggagaaugccgaggacauggggaacggaugcuuuaaaauuuaccacaagugugauaauaccugcaucggcagcaucagaaacgggacauaugaccaugaugcuuaccgcgacgaagcccucaauaaccgguuccagauuaagggcguugagcugaaaucuggauacaaggacuggauccuuuggauuuccuuugccaucagcugcuuccugcucuguguggcucugcugggcuuuauuaugugggccugccaaaaagggaauaucagauguaacaucugcauuuga

SEQ ID NO: 191275 - RNA, 1701 nt, Artificial Sequence
  derived and/or modified sequence opt5 from hemagglutinin__InfluenzaA__AFB77692
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaagccagcggacgcauuacaguuucuaccaagagaucccagcaggcugugaucccgaauacaggcagccggccccgcgucagaaacauuccuucccggaucucuaucuacuggaccauugugaaacccggggauauccugcugauuaauagcaccggaaaccucaucgccccucgcggcuacuucaagauuagauccgggaaaagcucuaucaugcgguccgacgcucccaucggaaaguguaauagcgaaugcauuacaccgaacggcucuaucccuaaugacaagcccuuucagaacgugaaucgcauuacguauggcgccuguccuagauacgucaaacaaaacacccugaaacuugcgacagggaugcggaauguucccgagaagcagacccgcggaaucuucggcgccauugcuggguuuaucgaaaacggaugggagggcaugguggaugggugguauggauucagacaccagaauagcgagggccggggccaagccgcugaccugaaguccacacaggccgccaucgaucagauuaacgggaaacucaacagacugaucggaaagaccaaugaaaaauuccaccagauugagaaggaauuuucugagguggaaggccgcauccaagaccuugagaaguacgucgaggauacgaaaauugaccuguggagcuauaacgcugaacuccugguggcgcuggagaaucagcauacaaucgaucucaccgacuccgaaaugaacaagcuguucgagaaaaccaagaaacagcuucgggaaaaugccgaggauauggggaacggaugcuuuaagauuuaccacaagugugacaaugcuugcaucggcagcaucagaaacgggacauaugaucaugacguuuaccgcgacgaggcccugaauaaccgguuccagauuaaaggcguggaacucaagucuggauacaaagauuggauccuguggauuuccuuugccaucagcugcuuccuucugugugucgcucuccugggcuuuauuaugugggccugccaaaaggggaauaucagauguaacaucugcauuuga

SEQ ID NO: 191276 - RNA, 1701 nt, Artificial Sequence; identical to SEQ ID NO: 190806
  derived and/or modified sequence opt5 from hemagglutinin__InfluenzaA__AFB77693

SEQ ID NO: 191277 - RNA, 1701 nt, Artificial Sequence
  derived and/or modified sequence opt5 from hemagglutinin__InfluenzaA__AFB77694
augaagaccaucauugcccugagcuacauccucugccugguguucgcucagaaacuucccggcaacgacaauuccacagccacgcugugucucgggcaccaugcggucccuaacggaaccauuguuaagacaaucgcuaaugaucaaauugaggugaccaacgccacagaacuggugcaaaauucuagcaccggcgagaucugcgacuccccgcaccagauccuugauggggaaaacuguacacugauugacgcccuccugggagauccccagugcgacgauuuucagaauaaaaagugggaccuguucgucgagagaucuaaggcuuauagcaacuguuacccuuaugaugugcccgacuacgccucccuccggucucugguugcuagcuccggcacccuugaauuuaauaacgagagcuucaauuggacgggggugacccagaacggaacaucuuccgccugcauccgcagaagcaauaacuccuuuuucucucggcugaauuggcucacccaucugaacuuuaaguauccugcgcuuaacgucacaaugcccaauaacgagcaguucgauaagcuguacauuuggggcgugcaccauccuggcaccgacaaagaucagaucuuucucuaugcccaagcuagcgggcgcauuacgguuucuacaaagagaucccagcaggccgugaucccgaauauuggaagccggccccgcgucagaaacaucccuucccggaucucuauuuacuggaccaucgugaaacccggcgacauucugcugaucaauagcacagggaaccucauugcuccucgcggauacuucaagaucagauccggcaaaagcucuaucaugcgguccgacgcccccauugggaaguguaauagcgaaugcaucaccccgaacggaucuauuccuaaugauaagcccuuucagaacgugaaucgcaucaccuauggcgcguguccuagauacgucaaacaaaacacacugaaacuugccacgggcaugcggaauguucccgagaaacagacccgcgggauuuucggagcuaucgccggcuuuaucgaaaacgggugggagggaaugguggacggcugguauggguucagacaccagaauagcgagggacggggccaagcugccgaucugaaguccacacaggccgcuauugaccagaucaacggcaaacucaacagacugauugggaagaccaaugaaaaauuccaccagaucgagaaggaauuuucugagguggaaggacgcauucaagaucuugagaaguacgucgaggacacaaaaaucgaucuguggagcuauaacgcggaacuccugguggcccuggagaaucagcauaccauugaccucacggauuccgaaaugaacaagcuguucgagaaaacaaagaaacagcuucgggaaaaugcugaggacaugggcaacgggugcuuuaagaucuaccacaagugugauaauaccugcaucggaagcauuagaaacggcaccuaugaccaugacguuuaccgcgaugaggcccugaauaaccgguuccagaucaaagggguggaacucaagucuggcuacaaagacuggauucuguggaucuccuuugccauuagcugcuuccuucugugugucgcucuccugggauuuaucaugugggccugccaaaagggcaauaucagauguaacauuugcaucuga

SEQ ID NO: 191278 - RNA, 1701 nt, Artificial Sequence
  derived and/or modified sequence opt5 from hemagglutinin__InfluenzaA__AFB77695
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugauggggaaaacuguacccugauugacgcccuccugggagauccccagugcgacgauuuucagaauaaaaagugggaccuguucgucgagagaucuaaagccuauagcaacuguuacccuuaugaugugcccgacuacgcuucccuccggucucugguugccagcuccggcacgcuugaauuuaauaacgagagcuucaauuggaccggggugacacagaacggaaccucuuccgcuugcauccgcagaagcaauaacuccuuuuucucucggcugaauuggcucacacaucugaacuuuaaguauccugcccuuaacgucaccaugcccaauaacgagcaguucgauaagcuguacauuuggggcgugcaccauccuggcacggacaaagaucagaucuuucucuaugcgcaagccagcgggcgcauuacaguuucuaccaagagaucccagcaggcugugaucccgaauauuggaagccggccccgcgucagaaacaucccuucccggaucucuauuuacuggacaaucgugaaacccggcgacauucugcugaucaauagcaccgggaaccucauugccccucgcggauacuucaagaucagauccggcaaaagcucuaucaugcgguccgacgcucccauugggaaguguaauagcgaaugcaucaccccgaacggaucuauuccuaaugauaagcccuuucagaacgugaaucgcaucacauauggcgccuguccuagauacgucaaacaaaacacgcugaaacuugcgaccggcaugcggaauguucccgagaagcagacacgcgggauuuucggagccaucgcuggcuuuaucgaaaacgggugggagggaaugguggacggcugguauggguucagacaccagaauagcgagggacggggccaagccgcugaucugaaguccacccaggccgccauugaccagaucaacggcaaacucaacagacugauugggaagacaaaugaaaaauuccaccagaucgagaaggaauuuucugagguggaaggacgcauucaagaucuugagaaguacgucgaggacaccaaaaucgaucuguggagcuauaacgcugaacuccugguggcgcuggagaaucagcauacgauugaccucacagauuccgaaaugaacaagcuguucgagaaaaccaagaaacagcuucgggaaaaugccgaggacaugggcaacgggugcuuuaagaucuaccacaagugugauaaugcuugcaucggaagcauuagaaacggcaccuaugaccaugacguuuaccgcgaugaggcccugaauaaccgguuccagaucaaagggguggaacucaagucuggcuacaaagacuggauucuguggaucuccuuugccauuagcugcuuccuucugugugucgcucuccugggauuuaucaugugggccugccaaaagggcaauaucagauguaacauuugcaucuga

SEQ ID NO: 191279 - RNA, 1701 nt, Artificial Sequence
  derived and/or modified sequence opt5 from hemagglutinin__InfluenzaA__AFB78126
augaagaccaucauugcccugagcuacauccucugccugguguucgcucagaaacuucccggcaacgacaauuccacagccacgcugugucucgggcaccaugcggucucuaacggaacccugguuaagacaauuaccaaugaucaaaucgaggugacaaacgcuaccgaacuugugcagagcuccucuacaggcagaauuugcgacagcccucaccagauccuggauggggagaauuguacccucaucgacgcccugcugggagauccgcauugcgacggcuuucagaacaaagaaugggaucucuucgucgagcgguccaaggccuauucuaauuguuaccccuaugacgugccugauuacgcuagccugcgcucccuuguugccagcucugggacgcuggaauuuaacaaugaguccuucaacuggaccggaguggcucaagacggcacaagcucugccugcaaaagacgguccaauaagagcuuuuucucucgccucaacuggcugcaccagcuuaaguauaaauaccccgcgcugaaugucaccaugccuaacaaugagaaguuugauaaacucuauauuuggggcgugcaucaccccuccacagacagcgaucagaucuccauuuacgcccaggcuucugggagaguuaccgugagcacgaagcggucccaacagacagucaucccuaacauuggaagcucuccgugggugcgcggcgccuccagcagaaucucuauuuacuggaccaucgugaaacccggggacauccugcugauuaacagcacaggaaaucucaucgcuccucggggcuauuucaagauucgcuccgggaagucuagcaucaugagauccgacgcccccauuggaaaauguaacagcgaaugcaucaccccuaauggcucuauccccaacgauaagccguuucagaaugucaaccggauuaccuacggcgcguguccucgcuauguuaaacagaauacacugaagcuggccacggggaugagaaacgugcccgagaaacaaacccggggaaucuucggcgcuauugccggguuuaucgaaaauggaugggagggcaugguggacgggugguacggauuccgccaccagaacuccgagggcacaggccaggcugccgaucuuaagagcacccaagccgcuacaaaucagauuaacgggaaacucaauagacugaucgaaaagaccaacgagaaguuucaucagaucgaaaaagaguucucugaagucgagggacggauucaggaccuugagaaguauguggaagauacgaaaaucgaccugugguccuacaaugcggagcuccugguugcccuggaaaaccaacacacaauugaucucaccgacagcgagaugaacaagcuguucgaaagaaccaaaaagcagcuucgcgagaaugcugaggauaugggcaacgggugcuuuaagaucuaucauaaaugugacaaugccugcauuggauccauccggaacggcacauacgaucacgacguguacagagacgaagcccugaauaaccgcuuccagauuaagggggucgagcucaaaucuggcuauaaggauuggauccuguggaucagcuuugcuauuuccugcuuccuucugugugugguucuccugggauuuaucaugugggccugccagaaaggcaauauucgguguaacaucugcauuuga

SEQ ID NO: 191280 - RNA, 1701 nt, Artificial Sequence
  derived and/or modified sequence opt5 from hemagglutinin__InfluenzaA__AFC34056
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaacggacgcugaaacuugccaccgggaugcgcaacguccccgagaagcagacaagaggaaucuucggcgcgaucgccggguuuauugaaaauggaugggagggcaugguugaugggugguauggauuccggcaccagaacagcgagggcagaggccaagcugccgaccugaaguccacccaggcugccaucgaucagauuaaugggaaacucaaccgccugaucggaaagacaaaugaaaaauuccaccagauugagaaggaauuuagcgagguggaaggccggauccaagaccuugagaaguacguggaggauaccaaaauugaccuguggucuuauaacgccgaacuccuggucgcucuggagaaccagcauacgaucgaucucacagacuccgaaaugaauaagcuguucgagaaaaccaagaaacagcuuagagaaaacgcggaggauauggggaauggaugcuuuaagaucuaccacaagugugacaacgccugcauuggcagcauccgcaaugggaccuauaaccaugauguguaccgggacgaggcucugaauaacagauuccagauuaaaggcguugaacucaagucuggauacaaagacuggauccuguggauuuccuuugccaucagcugcuuccuucuguguguggcccuccugggcuuuaucaugugggcuugccaaaaggggaauauucgcuguaacaucugcauuuga

SEQ ID NO: 191281 - RNA, 1701 nt, Artificial Sequence; identical to SEQ ID NO: 191280
  derived and/or modified sequence opt5 from hemagglutinin__InfluenzaA__AFC34057

SEQ ID NO: 191282 - RNA, 1701 nt, Artificial Sequence
  derived and/or modified sequence opt5 from hemagglutinin__InfluenzaA__AFD32426
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguaaacucagaggaguggcuccccugcaucugggcaagugcaacaucgccgggcggauucucggaaauccugagugugaaucccugucuacagcuagcuccuggucuuauaucguugagaccccgagcuccgauaacggcacaugcuaccccggggacuucauugauuaugaagaacuucgcgagcagcugagcucuguguccagcuuugaaagauucgagaucuuuccuaaaaccucuuccuggcccaaucacgacagcaacaagggagucacggccgcguguccucaugccggcgcuaagucuuucuacaaaaaucucaucuggcuggugaagaaaggcaacuccuaucccaaacuuagcaaguccuacauuaaugauaaggggaaggaaguucuggugcucuggggaauccaccacccuucuaccagcgccgaccaacagucccuguaucagaacgcugauacauacgucuuugugggcagcucucgguacuccaaaaaguucaaaccggagauugccauccgccccaaggugagagaccaggaggggcggaugaauuauuacuggacccuggucgaaccuggagauaaaauuacauuugaggcgaccggcaaccucguugugccccgcuaugccuucgcuauggaaagaaacgccgggagcggaaucauuaucucugacacgccugugcaugacugcaauacaaagugucaaacaccccugggcgcuaucaacagcucccuuccguaccagaauauucacccugucaccaucggcgagugccccaaauaugugcggucugccaagcugcgcaugguuaccgggcucagaaacaccccuagcauucagucccggggacuguuuggcgccaucgcuggguucauugaaggaggcuggacagggaugaucgauggaugguacggcuaucaucaccagaaugagcaaggcagcggguacgcggccgaccagaagucuacgcagaacgcuaucaauggaauuaccaacaaagugaauacagucaucgagaagaugaacauucaguuuaccgccgugggcaaagaguucaauaaacuugagaagcgcauggaaaaccugaauaagaagguugaugacggguuucucgauaucuggacauacaacgccgagcugcuggugcuccuggaaaaugagagaacccuugacuuccacgauuccaacgucaaaaaccuguaugagaaggugaaaagccaacucaagaauaacgcuaaagaaauuggaaauggcuguuucgaguuuuaccauaagugcgacaacgaauguauggagucuguccggaaugggacguaugauuaccccaaguauuccgaagagagcaaacugaaccgcgagaagguggacggcguuaaacuugaauccaugggaaucuaccagauccuggccauuuauucuacaguggcgagcucccucguccugcuggugucucucggcgcuaucagcuucuggaugugcuccaaugggagccugcagugcagaauuuguaucuga

SEQ ID NO: 191283 - RNA, 1698 nt, Artificial Sequence
  derived and/or modified sequence opt5 from hemagglutinin__InfluenzaA__AFD32427
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcugugugaucucgacggagugaaaccccugauccugagagauugcuccguugcuggcuggcuccuggggaacccuaugugugacgaguucauuaaugugccggaauggucuuauaucgucgagaaggccaaccccgugaaugaucuuugcuacccuggagacuuuaacgauuaugaggaacugaaacaucuccugagccggauuaaucacuucgagaagauccagaucauucccaaguccucuuggagcucccaugaagcuagccuuggcguuucuuccgccuguccuuaccaagggaaaagcucuuucuuccgcaacguggucuggcugaucaagaaaaauuccacauaucccaccauuaagagaagcuacaacaauacaaaccaggaggaccuccuggugcuguggggaauccaccacccuaacgaugcggccgaacagaccaaacucuaucagaauccgacgaccuacauuucugugggcacauccacccugaaccaacggcuugucccccgcaucgcuacaagaagcaagguuaauggccaguccgggcggauggaguuuuucuggaccauucugaagccuaacgacgccaucaauuuugagucuaacggaaauuucaucgcucccgaauacgccuauaaaauugugaagaaaggcgacagcacgaucaugaaguccgagcucgaauacgggaacugcaauacaaaaugucagaccccucugggagcgauuaacagcucucuucccuaucagaauauccauccggugacaauuggcgagugcccuaaguacguccgcuccgccaaacugagaauggugaccgggcuccggaacacccccagcauccaaucucgcggacuguuuggcgcuaucgccggcuucauugaagggggauggacaggcaugaucgaugggugguauggauaccaccaucagaaugagcagggcagcggguaugcugccgaccagaaguccacgcaaaacgccauuaauggaaucaccaacaagguuaacacagugauugagaaaaugaauauccaguuuaccgcugucggcaaggaauuuaacaaacuggagaagagaauggaaaaucucaacaaaaagguggaugacggcuuucuggauaucuggacauacaaugcggagcuucugguucuccuggaaaacgagcggacccuugacuuccacgauucuaaugugaagaaccuguacgagaaagucaagagccagcucaaaaauaacgccaaggaaauugggaauggauguuucgaguuuuaucacaaaugcgacaacgaauguauggaguccgugcgcaauggcacguacgauuauccuaaguacagcgaagagucuaagcugaacagagagaaagucgacggggugaagcuggaauccaugggaaucuaucaaauucucgcuaucuacagcacaguugccucuucccuggugcuucuggucagccucggcgccauuuccuucuggaugugcucuaaugggagccugcagugccggaucuguauuuga

SEQ ID NO: 191284 - RNA, 1722 nt, Artificial Sequence
  derived and/or modified sequence opt5 from hemagglutinin__InfluenzaA__AFD32428
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgaccuugauggggucaaaccgcugauccucagagacuguucuguggccggauggcugcugggcaaucccaugugcgaugaauuuauuaacguuccugaguggagcuauaucguggaaaaggccaaucccgucaacgaccucuguuacccuggggauuucaaugacuaugaggagcugaaacaccuucugucccggauuaaccauuuugaaaagauccagauuauccccaagucuagcugguccagccacgaggcuucucucggaguguccagcgccugcccuuaccagggcaaaucuuccuucuuucgcaauguuguguggcugauuaagaaaaacagcaccuauccgacgaucaagagaucuuacaauaacaccaaucaagaagaucuucugguccucuggggcauccaucaccccaacgacgcugccgagcagacaaaacuguaucagaacccuaccacauacauuuccguggggaccagcacgcugaaucagcggcucgugccccgcaucgcgacaagauccaaggucaacggacaaucuggccggauggaguucuuuuggaccauucugaagccuaaugaugccaucaacuucgaaagcaaugggaacuuuauugcucccgaguacgccuauaaaaucguuaagaaaggagacuccacaaucaugaaaagcgaacuugaguacggcaauuguaacucugaaugcauuaccccgaauggguccaucccuaacgauaagcccuuccagaaugugaaccgcauuaccuauggagcuuguccuagauacgugaagcagaauacacugaaacucgccacgggcaugcggaacguccccgagaagcagacccgcggcaucuuuggggcgauugccggauucaucgagaauggcugggaagggaugguggacggaugguauggcuuuagacaccaaaacagcgaggggcggggacaggcugccgaccugaagucuacacaggcugccaucgaucaaauuaacggcaaacuuaaucgccugaucggcaagaccaacgaaaaauuccaucagauugagaaggaguucagcgaaguugaggggagaauccaggaccucgaaaaauacguggaggauacaaagauugaccugugguccuauaaugccgaacugcucgucgcucuggagaaccagcacaccaucgaucuuacggacucugaaaugaauaagcuguuugagaaaacaaagaaacaacuccgggagaacgcggaagauaugggaaauggcugcuucaagauuuaccauaaaugugacaacgccugcaucgggagcauccgcaauggaaccuacgaucacgacguguauagagaugaggcucugaacaaucgguuucagauuaagggcguugaacuuaaguccggguacaaagacuggauccuguggauuagcuucgccaucucuugcuuucuccuguguguggcccugcucggcuucauuaugugggcuugccagaagggaaacaucagauguaauaucugcauuuga

SEQ ID NO: 191285 - RNA, 1704 nt, Artificial Sequence
  derived and/or modified sequence opt5 from hemagglutinin__InfluenzaA__AFD32429
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcacccaggggaaaagaccgacggaccuuggacaguguggccugcucgggacccugaucggacccccucaaugcgaucaguuucuggaguucgacgccgaucucauuaucgaacggcgcgaaggcacagacgucuguuaucccggcaaguuuaccaaugaggagucucugagacagauucuucgggggagcggaggcaucgauaaagaauccaugggguucacauacucugggauucgcaccaacggcgccacgagcgcuugcagacgguccgggagcucuuuuuaugccgagaugaaguggcugcucuccaauagcgacaacgcugaguucccucagaugacaaagucuuaccgcaaucccagaaacaaaccugcccugaucauuuggggagugcaccauuccggcagcgcgaccgaacaaacaaaacuuuauggcucugggaauaagcugaucaccguuggauccagcaaguaccagcaguccuuuaccccgucucccggcgcccggccucaggugaacgggcaaagcggacgcaucgauuuccacuggcuccugcuggaccccaaugauacagucacguuuaccuucaacggcgcuuuuauugccccugacagagcuuccuucuuucggggagagagccucggagugcagucugauguuccccuggacuccggcuguaauagcgaaugcaucacaccgaacggcucuauuccuaacgacaaacccuuccagaaugugaaccgcaucaccuauggggccuguccuagauacgucaagcaaaauacacuuaagcuggcgaccggaaugcggaacgugcccgagaaacagacgcgcggcauuuucggggccaucgcuggauuuaucgaaaauggcugggaggggaugguggauggcugguacggauucagacaucagaacagcgaaggccgggggcaggccgcugaccucaaguccacacaagccgccauugaucagaucaauggaaaacugaacagacuuauuggcaagaccaaugagaaauuucaccagaucgagaaggaguucucugaagucgaagggcgcauucaggaccuggagaaauauguugaagauaccaagaucgaccucuggagcuacaacgcugagcugcugguggcgcucgagaaucaacacacaaucgaucugaccgacuccgaaaugaacaaacuuuuugagaagacaaagaaacagcugcgggaaaaugccgaggauaugggaaacggcugcuucaagauuuaucauaaaugugacaaugcuugcaucgggagcauuagaaacggcacguacgaucacgacguguaucgcgacgaagcccucaacaaucgguuucagaucaagggagucgagcugaagucuggcuacaaagauuggauucuuuggaucuccuucgccauuagcugcuuucugcucuguguggcucugcugggguucaucaugugggccugccagaagggaaacaucagauguaauauuugcaucuga

SEQ ID NO: 191286 - RNA, 1701 nt, Artificial Sequence; identical to SEQ ID NO: 183097
  derived and/or modified sequence opt5 from hemagglutinin__InfluenzaA__AFD63527

SEQ ID NO: 191287 - RNA, 1701 nt, Artificial Sequence
  derived and/or modified sequence opt5 from hemagglutinin__InfluenzaA__AFD63538
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagcaucguugccuccagcggaacgcuggaguuuaacaaugaaucuuucaacuggaccggcgugacacagaauggcaccuccagcgcuugcaagcgcaagucuaacaaauccuuuuucagcagacuuaauuggcugacacaucucaaguauaaauacccugcccugaacgucaccaugcccaauaacgagaaguuugacaaacuuuauauuuggggagugcaccauccugggacggauaacgaccagaucucucuguacgcgcaggccuccggccggauuacaguuagcaccaagcgcucccaacagacagugaucccgaauauugggucuagaccccggguccgcgaugugagcuccagaaucagcaucuacuggaccauugugaagccuggagacauccuccugauuaacucuaccggcaaucugaucgcuccccggggguauuucaaaauucgcuccggaaagagcucuaucaugagaagcgacgccccuaucggcaaauguaacuccgagugcauuacacccaauggcucuaucccgaacgauaagccuuuucagaaugucaaccggauuacguacggggcuuguccccgcuauguuaaacagaauacccucaagcuggccacaggaaugagaaacgugccugaaaaacaaacccggggcaucuucggggcgauugccggauuuaucgagaauggcugggaagggaugguggacggaugguacggcuuccgccaccagaacagcgagggcacagggcaggcugccgaucuuaaguccacccaagcugccaucaaucagauuaacggaaagcugaauagacucaucggcaaaacgaacgagaaguuucaccagauugaaaaagaguucagcgaagucgaggggcggauccaggaccuggaaaaguauguggaggauacaaaaauugaccuuuggucuuacaacgccgagcugcucguugcucuggaaaaucaacauaccaucgaucugaccgacuccgagaugaacaaacucuucgaaagaacaaagaagcagcugcgcgagaaugcggaagauaugggaaacggcugcuuuaagauuuaucacaaaugugacaaugccugcaucgggagcauccggaacggcaccuacgaucaugacguguacagagacgaggcucuuaauaaccgcuaucagauuaagggagucgagcugaaaucuggcuacaaggauuggauccucuggauuuccuucgccaucagcugcuuucugcuuuguguggcccugcucggguucauuaugugggcuugccagaagggaaauauccgguguaacaucugcauuuga

SEQ ID NO: 191288 - RNA, 1701 nt, Artificial Sequence
  derived and/or modified sequence opt5 from hemagglutinin__InfluenzaA__AFD63549
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacaacgaucagaucagccucuacgcgcaggccucuggccgcauuacaguuuccaccaaaagaagccaacagacagugaucccgaacauugggucccggccccgcgucagagacgugucuagccggaucuccaucuacuggaccauugugaagccuggagacauccugcugauuaauagcaccggcaaccucaucgcuccccgcggguauuucaagauuagaucuggaaaauccagcaucaugcggucugaugccccuaucggcaaguguaauagcgagugcauuacacccaacggcuccaucccgaaugacaaaccuuuucagaacgucaaucgcauuacguacggggcuugucccagauauguuaagcagaacacccugaaacuugccacaggaaugcggaaugugccugaaaagcaaacccgcggcaucuucggggcgauugccggauuuaucgagaacggcugggaagggaugguggauggaugguacggcuucagacaccaaaauucugagggcacagggcaggcugccgaccugaaaagcacccaggcugccaucaaccagauuaauggaaagcucaaccggcugaucggcaagacgaaugagaaauuucaccagauugaaaaggaguucuccgaagucgaggggagaauccaggaucuugaaaaauauguggaggacacaaagauugaucuguggagcuacaacgccgagcuccugguugcucuggaaaaccaacauaccaucgaccucaccgauucugagaugaauaaacuguucgaacgcacaaagaagcagcuucgggagaacgcggaagacaugggaaauggcugcuuuaaaauuuaucacaagugugauaacgccugcaucggguccaucagaaauggcaccuacgaccaugacguguaccgcgaugaggcucugaacaaucgguuccagauuaaaggagucgagcucaagagcggcuauaaagacuggauccuguggauuucuuuugccaucuccugcuuccuucuguguguggcccuccugggguuuauuaugugggcuugccagaagggaaacaucagauguaauaucugcauuuga

SEQ ID NO: 191289 - RNA, 1701 nt, Artificial Sequence; identical to SEQ ID NO: 183097
  derived and/or modified sequence opt5 from hemagglutinin__InfluenzaA__AFD63571

SEQ ID NO: 191290 - RNA, 1701 nt, Artificial Sequence
  derived and/or modified sequence opt5 from hemagglutinin__InfluenzaA__AFD63615
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaaauccuuuuucagcagacugaauuggcucacacaucugaaguauaaauacccugcccuuaacgucaccaugcccaauaacgagaaguuugacaaacuguauaucuggggagugcaccauccugggacggauaacgaccagauuucucucuacgcgcaggccuccggccggaucacaguuagcaccaagcgcucccaacagacagugauuccgaauaucgggucuagaccccggguccgcgaugugagcuccagaauuagcaucuacuggaccaucgugaagccuggagacauucugcugaucaacucuaccggcaaucucauugcuccccggggguauuucaaaauccgcuccggaaagagcucuauuaugagaagcgacgccccuaucggcaaauguaacuccgagugcaucacacccaauggcucuauuccgaacgauaagccuuuucagaaugucaaccggaucacguacggggcuuguccccgcuauguuaaacagaauacccugaaacuugccacaggaaugagaaacgugccugaaaagcaaacccggggcauuuucggggcgaucgccggauuuauugagaauggcugggaagggaugguggacggaugguacggcuuccgccaccagaacagcgagggcacagggcaggcugccgaucugaaguccacccaagcugccaucaaucagaucaacggaaagcucaauagacugauuggcaaaacgaacgagaaguuucaccagaucgaaaaagaguucagcgaagucgaggaacggauucaggaccuugagaaguauguggaggauacaaaaaucgaccuguggucuuacaacgccgaacuccugguugcucuggagaaucaacauaccauugaucucaccgacuccgaaaugaacaagcuguucgagagaacaaagaaacagcuucgcgaaaaugcggaggauauggggaacggaugcuuuaagaucuaucacaaaugugacaaugccugcauuggcagcauccggaacgggaccuacgaucaugacguguacagagacgaggcucugaauaaccgcuuccagaucaagggcgucgaacucaaaucuggauauaaggauuggauucuguggaucuccuuugccauuagcugcuuccuucuguguguggcccuccugggcuuuaucaugugggcuugccagaaggggaauauucgguguaacaucugcaucuga

SEQ ID NO: 191291 - RNA, 1701 nt, Artificial Sequence
  derived and/or modified sequence opt5 from hemagglutinin__InfluenzaA__AFD63626
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacaucagcucccggaucagcauuuacuggaccaucgugaagccuggagacauucugcugaucaacucuaccggcaaucucauugcuccccgcggguauuucaagaucagauccggaaaaagcucuaucaugcggagcgaugccccuauuggcaaguguaacuccgagugcaucacacccaauggcucuauuccgaacgacaaaccuuuucagaaugugaaccgcaucacguacggggcuugucccagauaugucaagcagaauacccugaaacuugccacaggaaugcggaacguuccugaaaagcaaacccgcggcauuuucggggcgaucgccggauuuaucgagaauggcugggaagggaugguggauggaugguacggcuucagacaccagaacagcgagggcacagggcaggcugccgaccugaaauccacccaagcugccauuaaucagaucaacggaaagcucaaucggcugauuggcaagacgaacgagaaauuucaccagaucgaaaaggaguucagcgaaguggaggggcgcauucaggaucuugaaaaauaugucgaggacacaaagaucgaucuguggucuuacaaugccgagcuccugguggcucuggaaaaccaacauaccauugaccucaccgauuccgagaugaacaaacuguucgaaagaacaaagaagcagcuucgggagaaugcggaagacaugggaaacggcugcuuuaaaaucuaucacaagugugauaaugccugcaucgggagcauuagaaacggcaccuacgaccaugacguuuaccgcgaugaggcucugaauaaccgguuccagaucaaaggaguggagcucaagucuggcuauaaagacuggauucuguggaucuccuuugccauuagcugcuuccuucugugugucgcccuccugggguuuaucaugugggcuugccagaagggaaauaucagauguaacauuugcaucuga

SEQ ID NO: 191292 - RNA, 1701 nt, Artificial Sequence
  derived and/or modified sequence opt5 from hemagglutinin__InfluenzaA__AFD63637
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccacaugcaagcgcagaagcaauaagagcuuuuucucccggcugaacuggcucacccaucugaaauauaaguacccugcucuuaaugucacgaugcccaacaaugagaaauuugauaagcuguauauuuggggagugcaccauccugggacagacagcgaucagaucucucucuacgcccaggcguccggccgcauuaccguuagcacaaaaagaucccaacagaccgugaucccgaacauugggucucggccccgcgucagagacgugagcucccggaucagcaucuacuggaccauugugaagccuggagacauccugcugauuaacucuacaggcaaucucaucgcuccccgcggguauuucaagauuagauccggaaaaagcucuaucaugcggagcgaugccccuaucggcaaguguaacuccgagugcauuacgcccaauggcucuaucccgaacgacaaaccuuuucagaaugucaaccgcauuaccuacggggccugucccagauauguuaagcagaauacacugaaacuugcuaccggaaugcggaacgugccugaaaagcaaacacgcggcaucuucggggccauugcgggauuuaucgagaauggcugggaagggaugguggauggaugguacggcuucagacaccagaacagcgagggcaccgggcaggccgcugaccugaaauccacgcaagccgcuaucaaucagauuaacggaaagcucaaucggcugaucggcaagacaaacgagaaauuucaccagauugaaaaggaguucagcgaagucgaggggagaauccaggaucuugaaaaauauguggaggacaccaagauugaucuguggucuuacaaugccgagcuccugguugcccuggaaaaccaacauaccaucgaccucacagauuccgagaugaacaaacuguucgaacgcaccaagaagcagcuucgggagaaugcugaagacaugggaaacggcugcuuuaaaauuuaucacaagugugauaaugcgugcaucgggagcaucagaaacggcacauacgaccaugacguguaccgcgaugaggcccugaauaaccgguuccagauuaaaggagucgagcucaagucuggcuauaaagacuggauccuguggauuuccuuugcuaucagcugcuuccuucuguguguggcccuccugggguuuauuaugugggccugccagaagggaaauaucagauguaacaucugcauuuga

SEQ ID NO: 191293 - RNA, 1701 nt, Artificial Sequence
  derived and/or modified sequence opt5 from hemagglutinin__InfluenzaA__AFD63648
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcagaucucuagcaccggcgggaucugcgacuccccgcaccagauucuugauggagagaauuguacacugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacccuugaguuuaacaaugaaucuuucgacuggacgggcgugacccagaacggcacaucuuccgcuugcaagcgcagaagcaauaagagcuuuuucucccggcugaacuggcucacccaucugaaauauaaguacccugcccuuaaugucacaaugcccaacaaugagaaauuugauaagcuguauauuuggggagugcaccauccugggaccgacagcgaucagaucucucucuacgcgcaggccuccggccgcauuacgguuagcacaaaaagaucccaacagaccgugaucccgaacauugggucucggccccgcgucagagacgugagcucccggaucagcaucuacuggacaauugugaagccuggagacauccugcugauuaacucuaccggcaaucucaucgcuccccgcggguauuucaagauuagauccggaaaaagcucuaucaugcggagcgaugccccuaucggcaaguguaacuccgagugcauuacccccaauggcucuaucccgaacgacaaaccuuuucagaaugucaaccgcauuacauacggggcuugucccagauauguuaagcagaauacgcugaaacuugccaccggaaugcggaacgugccugaaaagcaaacacgcggcaucuucggggcgauugccggauuuaucgagaauggcugggaagggaugguggauggaugguacggcuucagacaccagaacagcgagggcaccgggcaggcugccgaccugaaauccacacaagcugccaucaaucagauuaacggaaagcucaaucggcugaucggcaagaccaacgagaaauuucaccagauugaaaaggaguucagcgaagucgaggggagaauccaggaucuugaaaaauauguggaggacacgaagauugaucuguggucuuacaaugccgagcuccugguugcucuggaaaaccaacauacaaucgaccucaccgauuccgagaugaacaaacuguucgaacgcaccaagaagcagcuucgggagaaugcggaagacaugggaaacggcugcuuuaaaauuuaucacaagugugauaaugccugcaucgggagcaucagaaacggcacauacgaccaugacguguaccgcgaugaggcucugaauaaccgguuccagauuaaaggagucgagcucaagucuggcuauaaagacuggauccuguggauuuccuuugccaucagcugcuuccuucuguguguggcccuccugggguuuauuaugugggcuugccagaagggaaauaucagauguaacaucugcauuuga

SEQ ID NO: 191294 - RNA, 1701 nt, Artificial Sequence; identical to SEQ ID NO: 183097
  derived and/or modified sequence opt5 from hemagglutinin__InfluenzaA__AFD63659

SEQ ID NO: 191295 - RNA, 1701 nt, Artificial Sequence
  derived and/or modified sequence opt5 from hemagglutinin__InfluenzaA__AFD63681
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaaauccuuuuucagcagacugaauuggcucacacaucugaaguauaaauacccugcccuuaacgucaccaugcccaauaacgagaaguuugacaaacuguauaucuggggagugcaccauccugggacggauaacgaccagauuucucucuacgcgcaggccuccggccggaucacaguuagcaccaagcgcucccaacagacagugauuccgaauaucgggucuagaccccggguccgcgaugugagcuccagaauuagcaucuacuggaccaucgugaagccuggagacauucugcugaucaacucuaccggcaaucucauugcuccccggggguauuucaaaguccgcuccggaaagagcucuaucaugagaagcgacgccccuauuggcaaauguaacuccgagugcaucacacccaauggcucuaucccgaacgauaagccuuuucagaauguuaaccggauuacguacggggcuuguccccgcuaugugaaacagaauacccugaaacuugccacaggaaugagaaacgugccugaaaagcaaacccggggcaucuucggggcgauugccggauuuaucgagaauggcugggaagggauggucgacggaugguacggcuuccgccaccagaacagcgagggcacagggcaggcugccgaucugaaguccacccaagcugccauuaaucagaucaacggaaagcucaauagacugaucggcaaaacgaacgagaaguuucaccagauugaaaaagaguucagcgaaguggaggggcggauccaggaccuugaaaaguauguugaggauacaaaaauugaccuguggucuuacaacgccgagcuccugguggcucuggaaaaucaacauaccaucgaucucaccgacuccgagaugaacaagcuguucgaaagaacaaagaaacagcuucgcgagaaugcggaagauaugggaaacggcugcuuuaagauuuaucacaaaugugacaaugccugcaucgggagcauucggaacggcaccuacgaucaugacgucuacagagacgaggcucugaauaaccgcuuccagaucaagggaguggagcucaaaucuggcuauaaggauuggauccuguggauuuccuuugccaucagcugcuuccuucuguguguugcccuccugggguuuauuaugugggcuugccagaagggaaauauccgguguaacauuugcaucuga

SEQ ID NO: 191296 - RNA, 1701 nt, Artificial Sequence
  derived and/or modified sequence opt5 from hemagglutinin__InfluenzaA__AFD63692
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcuccacccugggacggacucugaucagauuucccuguacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcucaucaacuccaccggcaaucugauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccuuaaacuggccacaggaaugcggaacgugccugaaaagcaaacccgcggcauuuucggggcgaucgccggauuuauugagaauggcugggaagggaugguggauggaugguacggcuucagacaucagaacuccgagggcacagggcaggcugccgaccucaaaagcacccaagcugccaucaaucagaucaacggaaagcugaaucggcuuauuggcaagacgaacgagaaauuucaccagaucgaaaaggaguucucugaagucgaggggcgcauucaggaucuggaaaaauauguggaggacacaaagaucgaucucugguccuacaaugccgagcugcugguugcucucgaaaaccaacacaccauugaccugaccgauagcgagaugaacaaacuuuucgaaagaacaaagaagcagcugcgggagaaugcggaagacaugggaaacggcugcuuuaaaaucuaucauaagugugauaaugccugcauugggucuaucagaaacggcaccuacgaccacgacguguaccgcgaugaggcucucaauaaccgguuccagaucaaaggagucgagcugaaguccggcuauaaagacuggauucuuuggaucagcuuugccauuuccugcuuccugcucuguguggcccugcugggguuuaucaugugggcuugccagaagggaaauauuagauguaacaucugcaucuga

SEQ ID NO: 191297 - RNA, 1701 nt, Artificial Sequence
  derived and/or modified sequence opt5 from hemagglutinin__InfluenzaA__AFD63703
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacauccggcaucugcgacucuccguaucagauucuugauggggagaauuguacccugaucgacgcccuccugggagauccccagugcgacggcuuucaaaacaaaaagugggaucuguucgucgaaagaagcaaagccuacuccaauuguuauccuuacgacgugcccgauuaugcuucucuccggagccugguugccuccagcgggacgcuugaguuuaacaaugaaucuuucgacuggaccggagugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacauuuggggcgugcaucacccugggacggacucugaucagaucucccucuacgcgcaggccagcggacgcauuacaguuuccaccaaaagaucucaacagacagugaucccgaacauuggcagccggccccgcgucagagacguguccagccagaucucuaucuauuggaccauugugaagccuggggacauccugcugauuaacuccaccggaaaucucaucgcuccccggggcuacuucaagauucgcagcgggaaaucuagcaucaugagauccgaugccccuaucggaaaguguaacucugagugcauuacacccaauggcagcaucccgaacgacaaaccuuuucagaaugucaaccggauuacguauggcgcuuguccccgcuacguuaagcaaaauacccugaaacuugccacagggaugagaaacgugccugaaaagcagacccggggaaucuucggcgcgauugccggguuuaucgagaauggaugggaaggcaugguggaugggugguauggauuccgccaucagaacuccgagggcacaggccaagcugccgaccugaaaagcacccaggcugccaucaaucagauuaacgggaagcucaauagacugaucggaaagacgaacgagaaauuucaccagauugaaaaggaguucucugaagucgagggccggauccaagaucuugaaaaauacguggaggacacaaagauugaucugugguccuauaaugccgagcuccugguugcucuggaaaaccagcacaccaucgaccucaccgauagcgagaugaacaaacuguucgaaagaacaaagaagcagcuucgcgagaaugcggaagacauggggaacggaugcuuuaaaauuuaccauaagugugauaaugccugcaucggcucuauccggaacgggaccuacgaccacgacguguauagagaugaggcucugaauaaccgcuuccagauuaaaggcgucgagcucaaguccggauacaaagacuggauccuguggauuagcuuugccaucuccugcuuccuucuguguguggcccuccugggcuuuauuaugugggcuugccaaaaggggaauauccgguguaacaucugcauuuga

SEQ ID NO: 191298 - RNA, 1701 nt, Artificial Sequence
  derived and/or modified sequence opt5 from hemagglutinin__InfluenzaA__AFD63714
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccacaugcaagcgcagaagcaauaagagcuuuuucucccggcugaacuggcucacccaucugaaauauaaguacccugcucuuaaugucacgaugcccaacaaugagaaauuugauaagcuguauauuuggggagugcaccauccugggacagacaacgaucagaucagccucuacgcccaggcgucuggccgcauuaccguuuccacaaaaagaagccaacagaccgugaucccgaacauugggucccggccccgcgucagagacgugucuagccggaucuccaucuacuggaccauugugaagccuggagacauccugcugauuaauagcacaggcaaccucaucgcuccccgcggguauuucaagauuagaucuggaaaauccagcaucaugcggucugaugccccuaucggcaaguguaauagcgagugcauuacgcccaacggcuccaucccgaaugacaaaccuuuucagaacgucaaucgcauuaccuacggggccugucccagauauguuaagcagaacacacugaaacuugcuaccggaaugcggaaugugccugaaaagcaaacacgcggcaucuucggggccauugcgggauuuaucgagaacggcugggaagggaugguggauggaugguacggcuucagacaccaaaauucugagggcaccgggcaggccgcugaccugaaaagcacgcaggccgcuaucaaccagauuaauggaaagcucaaccggcugaucggcaagacaaaugagaaauuucaccagauugaaaaggaguucuccgaagucgaggggagaauccaggaucuugaaaaauauguggaggacaccaagauugaucuguggagcuacaacgccgagcuccugguugcccuggaaaaccaacagaccaucgaccucacagauucugagaugaauaaacuguucgaacgcaccaagaagcagcuucgggagaacgcugaagacaugggaaauggcugcuuuaaaauuuaucauaagugugauaacgcgugcaucggguccaucagaaauggcacauacgaccacgacguguaccgcgaugaggcccugaacaaucgguuccauauuaaaggagucgagcucaagagcggcuauaaagacuggauccuguggauuucuuuugcuaucuccugcuuccuucuguguguggcccuccugggguuuauuaugugggccugccagaagggaaacaucagauguaauaucugcauuuga

SEQ ID NO: 191299 - RNA, 1701 nt, Artificial Sequence
  derived and/or modified sequence opt5 from hemagglutinin__InfluenzaA__AFD63736
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccacaugcaagcgcagaagcaauaagagcuuuuucucccggcugaacuggcucacccaucugaaauauaaguacccugcucuuaaugucacgaugcccaacaaugagaaauuugauaagcuguauauuuggggagugcaccauccugggacagacaacgaucagaucagccucuacgcccaggcgucuggccgcauuaccguuuccacaaaaagaagccaacagaccgugaucccgaacauugggucccggccccgcgucagagacgugucuagccggaucuccaucuacuggaccauugugaagccuggagacauccugcugauuaauagcacaggcaaccucaucgcuccccgcggguauuucaagauuagaucuggaaaauccagcaucaugcggucugaugccccuaucggcaaguguaauagcgagugcauuacgcccaacggcuccaucccgaaugacaaaccuuuucagaacgucaaucgcauuaccuacggggccugucccagauauguuaagcagaacacacugaaacuugcuaccggaaugcggaaugugccugaaaagcaaacacgcggcaucuucggggccauugcgggauuuaucgagaacggcugggaagggaugguggauggaugguacggcuucagacaccaaaauucugagggcaccgggcaggccgcugaccugaaaagcacgcaggccgcuaucaaccagauuaauggaaagcucaaccggcugaucggcaagacaaaugagaaauuucaccagauugaaaaggaguucuccgaagucgaggggagaauccaggaucuugaaaaauauguggaggacaccaagauugaucuguggagcuacaacgccgagcuccugguugcccuggaaaaccaacauaccaucgaccucacagauucugagaugaauaaacuguucgaacgcaccaagaagcagcuucgggagaacgcugaagacaugggaaauggcugcuuuaaaauuuaucacaagugugauaacgcgugcaucggguccaucagaaauggcacauacgaccaugacguguaccgcgaugaggcccugaacaaucgguuccacauuaaaggagucgagcucaagagcggcuauaaagacuggauccuguggauuucuuuugcuaucuccugcuuccuucuguguguggcccuccugggguuuauuaugugggccugccagaagggaaacaucagauguaauaucugcauuuga

SEQ ID NO: 191300 - RNA, 1701 nt, Artificial Sequence
  derived and/or modified sequence opt5 from hemagglutinin__InfluenzaA__AFD63747
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucacagaaucgaaaaggaguucucugaagucgaggggcgcauucaggaucuugaaaaauauguggaggacacaaagaucgaucugugguccuacaaugccgagcuccugguugcucuggaaaaccagcauaccauugaccucaccgauagcgagaugaacaaacuguucgaacggacaaagaagcaacuuagagagaaugcggaagacaugggaaacggcugcuuuaaaaucuaucacaagugugauaaugccugcauugggucuauccgcaacggcaccuacgaccaugacguguaccgggaugaggcucugaauaacagauuccagaucaaaggagucgagcucaaguccggcuauaaagacuggauucuguggaucagcuuugccauuuccugcuuccuucuguguguggcccuccugggguuuaucaugugggcuugccagaagggaaauauucgcuguaacaucugcaucuga

SEQ ID NO: 191301 - RNA, 1701 nt, Artificial Sequence
  derived and/or modified sequence opt5 from hemagglutinin__InfluenzaA__AFD63758
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaaauccuuuuucagcagacugaauuggcucacacaucugaaguauaaauacccugcccuuaacgucaccaugcccaauaacgagaaguuugacaaacuguauaucuggggagugcaccauccugggacggauaacgaccagauuucucucuacgcgcaggccuccggccggaucacaguuagcaccaagcgcucccaacagacagugauuccgaauaucgggucuagaccccggguccgcgaugugagcuccagaauuagcaucuacuggaccaucgugaagccuggagacauucugcugaucaacucuaccggcaaucucauugcuccccggggguauuucaaaauccgcuccggaaagagcucuauuaugagaagcgacgccccuaucggcaaauguaacuccgagugcaucacacccaauggcucuauuccgaacgauaagccuuuucagaaugucaaccggaucacguacggggcuuguccccgcuauguuaaacagaauacccugaaacuugccacaggaaugagaaacgugccugaaaagcaaacccggggcauuuucggggcgaucgccggauuuauugagaauggcugggaagggaugguggacggaugguacggcuuccgccaccagaacagcgagggcacagggcaggcugccgaucugaaguccacccaagcugccaucaaucagaucaacggaaagcucaauagacugauuggcaaaacgaacgagaaguuucaccagaucgaaaaagaguucagcgaagucgaggggcggauucaggaccuugaaaaguauguggaggauacaaaaaucgaccuguggucuuacaacgccgagcuccugguugcucuggaaaaucaacauaccauugaucucaccgacuccgagaugaacaagcuguucgaaagaacaaagaaacagcuucgcgagaaugcggaagauaugggaaacggcugcuuuaagaucuaucacaaaugugacaaugccugcauugggagcauccggaacggcaccuacgaucaugacguguacagagacgaggcucugaauaaccgcuuccagaucaagggagucgagcucaaaucuggcuauaaggauuggauucuguggaucuccuuugccauuagcugcuuccuucuguguguggcccuccugggguuuaucaugugggcuugccagaagggaaauauucgguguaacaucugcaucuga

SEQ ID NO: 191302 - RNA, 1701 nt, Artificial Sequence
  derived and/or modified sequence opt5 from hemagglutinin__InfluenzaA__AFD63769
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacaacgaucagaucagccucuacgcgcaggccucuggccgcauuacaguuuccaccaaaagaagccaacagacagugaucccgaacauugggucccggccccgcgucagagacgugucuagccggaucuccaucuacuggaccauugugaagccuggagacauccugcugauuaauagcaccggcaaccucaucgcuccccgcggguauuucaagauuagaucuggaaaauccagcaucaugcggucugaugccccuaucggcaaguguaauagcgagugcauuacacccaacggcuccaucccgaaugacaaaccuuuucagaacgucaaucgcauuacguacggggcuugucccagauauguuaagcagaacacccugaaacuugccacaggaaugcggaaugugccugaaaagcaaacccgcggcaucuucggggcgauugccggauuuaucgagaacggcugggaagggaugguggauggaugguacggcuucagacaccaaaauucugagggcacagggcaggcugccgaccugaaaagcacccaggcugccaucaaccagauuaauggaaagcucaaccggcugaucggcaagacgaaugagaaauuucaccagauugaaaaggaguucuccgaagucgaggggagaauccaggaucuugaaaaauauguggaggacacaaagauugaucuguggagcuacaacgccgagcuccugguugcucuggaaaaccaacauaccaucgaccucaccgauucugagaugaauaaacuguucgaacgcacaaagaagcagcuucgggagaacgcggaagacaugggaaauggcugcuuuaaaauuuaucacaagugugauaacgccugcaucggguccaucagaaauggcaccuacgaccaugacguguaccgcgaugaggcucugaacaaucgguuccacauuaaaagcgucgagcucaagucuggauauaaagacuggauccuguggauuuccuuugccaucagcugcuuccuucuguguguggcccuccugggcuuuauuaugugggcuugccagaaggggaacaucagauguaauaucugcauuuga

SEQ ID NO: 191303 - RNA, 1701 nt, Artificial Sequence; identical to SEQ ID NO: 183097
  derived and/or modified sequence opt5 from hemagglutinin__InfluenzaA__AFD63780

SEQ ID NO: 191304 - RNA, 1701 nt, Artificial Sequence; identical to SEQ ID NO: 191301
  derived and/or modified sequence opt5 from hemagglutinin__InfluenzaA__AFD63791

SEQ ID NO: 191305 - RNA, 1701 nt, Artificial Sequence; identical to SEQ ID NO: 183097
  derived and/or modified sequence opt5 from hemagglutinin__InfluenzaA__AFD63802

SEQ ID NO: 191306 - RNA, 1701 nt, Artificial Sequence
  derived and/or modified sequence opt5 from hemagglutinin__InfluenzaA__AFD63813
augaagaccaucauugcccugagcuacauccucucccugguguucgcucagaaauuucccggcaacgacaauucuacagccacgcuuugccuggggcaccaugcggucccuaacggaaccauuguuaagacaaucaccaaugaucaaauugaggugacaaacgcuaccgaacucgugcagaucagcuccacaggcgggaucugugacucuccgcaccagauucuggauggagagaauugcacccuuaucgacgcccugcucggcgauccccagugugacggguuccaaaacaaaaagugggaucuguuugucgaaagaagcaaagccuauuccaauugcuacccuuaugacgugcccgauuacgcuucucugcggagccucguugccuccagcggaucucuggaguucaacaaugaauccuuugacuggacgggcgugacccagaacggcacaagcucugcuuguaagcgcagauccaauaagagcuucuuuucucggcuuaacuggcugacccaucucaaauauaaguacccugcccugaaugucacaaugcccaacaaugagaaauucgauaagcuguauauuuggggagugcaccauccugggaccgacuccgaucagaucagccuguacgcgcaggccuccggccgcauuacgguuucuacaaaaagaagccaacagaccgugaucccgaacauugggucccggccccgcgucagagacaucagcucucggaucuccauuuacuggacaaucgugaagccuggagacauucuccugaucaacagcaccggcaaucugauugcuccccgcggguauuuuaagaucagaucuggaaaaagcuccaucaugcggucugaugccccuauuggcaagugcaacagcgaguguaucacccccaauggcuccauuccgaacgacaaaccuuuccagaaugugaaccgcaucacauacggggcuugccccagauaugucaagcagaauacgcucaaacuggccaccggaaugcggaacguuccugaaaagcaaacacgcggcauuuuuggggcgaucgccggauucaucgagaauggcugggaagggaugguggauggaugguacggcuuuagacaccagaacagcgagggcaccgggcaggcugccgaccuuaaaucuacacaagcugccauuaaucagaucaacggaaagcugaaucggcucauuggcaagaccaacgagaaauuccaccagaucgaaaaggaguucuccgaaguggaggggcgcauucaggaucuggaaaaauaugucgaggacacgaagaucgaucuuuggagcuacaaugccgagcugcucguggcucuggaaaaccaacauacaauugaccugaccgauucugagaugaacaaacucuuugaaagaaccaagaagcagcugcgggagaaugcggaagacaugggaaacggcuguuucaaaaucuaucacaagugcgauaaugccuguaucggguccauuagaaacggcacauacgaccaugacguuuaccgcgaugaggcucuuaauaaccgguuucagaucaaaggaguggagcuuaagagcggcuauaaagacuggauucucuggaucuccuucgccaccucuugcuuucugcuuugcgucgcccugcucggguucauuaugugggcuugucagaagggaaauaucagaugcaacaucuguauuuga

SEQ ID NO: 191307 - RNA, 1701 nt, Artificial Sequence; identical to SEQ ID NO: 191291
  derived and/or modified sequence opt5 from hemagglutinin__InfluenzaA__AFD63824

SEQ ID NO: 191308 - RNA, 1701 nt, Artificial Sequence; identical to SEQ ID NO: 183097
  derived and/or modified sequence opt5 from hemagglutinin__InfluenzaA__AFD63846

SEQ ID NO: 191309 - RNA, 1701 nt, Artificial Sequence; identical to SEQ ID NO: 184335
  derived and/or modified sequence opt5 from hemagglutinin__InfluenzaA__AFD63857

SEQ ID NO: 191310 - RNA, 1701 nt, Artificial Sequence; identical to SEQ ID NO: 183097
  derived and/or modified sequence opt5 from hemagglutinin__InfluenzaA__AFD63868

SEQ ID NO: 191311 - RNA, 1701 nt, Artificial Sequence; identical to SEQ ID NO: 183097
  derived and/or modified sequence opt5 from hemagglutinin__InfluenzaA__AFD63890

SEQ ID NO: 191312 - RNA, 1701 nt, Artificial Sequence; identical to SEQ ID NO: 183097
  derived and/or modified sequence opt5 from hemagglutinin__InfluenzaA__AFD63901

SEQ ID NO: 191313 - RNA, 1701 nt, Artificial Sequence; identical to SEQ ID NO: 183097
  derived and/or modified sequence opt5 from hemagglutinin__InfluenzaA__AFD63912

SEQ ID NO: 191314 - RNA, 1701 nt, Artificial Sequence
  derived and/or modified sequence opt5 from hemagglutinin__InfluenzaA__AFD63923
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaaauccuuuuucagcagacugaauuggcucacacaucugaaguauaaauacccugcccuuaacgucaccaugcccaauaacgagaaguuugacaaacuguauaucuggggagugcaccauccugggacggauaacgaccagauuucucucuacgcgcaggccuccggccggaucacaguuagcaccaagcgcucccaacagacagugauuccgaauaucgggucuagaccccggguccgcgauauuagcuccagaaucagcaucuacuggaccauugugaagccuggagacauccugcugauuaacucuaccggcaaucucaucgcuccccggggguauuucaaaauucgcuccggaaagagcucuaucaugagaagcgacgccccuaucggcaaauguaacuccgagugcauuacacccaauggcucuaucccgaacgauaagccuuuucagaaugugaaccggauuacguacggggcuuguccccgcuaugucaaacagaauacccugaaacuugccacaggaaugagaaacguuccugaaaagcaaacccggggcaucuucggggcgauugccggauuuaucgagaauggcugggaagggaugguggacggaugguacggcuuccgccaccagaacagcgagggcacagggcaggcugccgaucugaaguccacccaagcugccaucaaucagauuaacggaaagcucaauagacugaucggcaaaacgaacgagaaguuucaccagauugaaaaagaguucagcgaaguggaggggcggauccaggaccuugaaaaguaugucgaggauacaaaaauugaccuguggucuuacaacgccgagcuccugguggcucuggaaaaucaacauaccaucgaucucaccgacuccgagaugaacaagcuguucgaaagaacaaagaaacagcuucgcgagaaugcggaagauaugggaaacggcugcuuuaagauuuaucacaaaugugacaaugccugcaucgggagcauccggaacggcaccuacgaucaugacguuuacagagacgaggcucugaauaaccgcuuccagauuaagggaguggagcucaaaucuggcuauaaggauuggauccuguggauuuccuuugccaucagcugcuuccuucugugugucgcccuccugggguuuauuaugugggcuugccagaagggaaauauccgguguaacaucugcauuuga

SEQ ID NO: 191315 - RNA, 1701 nt, Artificial Sequence
  derived and/or modified sequence opt5 from hemagglutinin__InfluenzaA__AFD63934
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggagucugaccagauuucccucuacgcgcaggccagcggccgcaucacaguuuccaccaaaagaucucaacagacagugauuccgaacaucgggagccggccccgcgucagagauguguccagccggauuucuaucuacuggaccguggucaagccuggagacauccugcugauuaacuccaccggcaaucucaucgcuccccgcggguauuucaagauuagaagcggaaaaucuagcaucaugcgguccgacgccccuauuggcaaguguaacucugaaugcaucacacccaauggcagcaucccgaacgauaaaccuuuucagaauguuaaccgcauuacguacggggcuugucccagauaugugaagcagaauacccugaaacuugccacaggaaugcggaacgugccugagaagcaaacccgcggcaucuucggggcgauugccggauuuaucgaaaauggcugggaggggauggucgacggaugguacggcuucagacaccagaacuccgagggcacagggcaggcugccgaucugaaaagcacccaagcugccauuaaucagaucaacggaaagcucaaucggcugaucggcaagacgaacgaaaaauuucaccagauugagaaggaguucucugaaguggaagggagaauccaggaccuugagaaauauguugaggauacaaagauugaccugugguccuacaaugccgaacuccugguggcucuggagaaccaacauaccaucgaucucaccgacagcgaaaugaacaaacuguucgagcgcacaaagaagcagcuucgggaaaaugcggaggauaugggaaacggcugcuuuaaaauuuaucacaagugugacaaugccugcaucgggucuauuagaaacggcaccuacgaucaugacgucuaccgcgacgaggcucugaauaaccgguuccagaucaaaggaguggaacucaaguccggcuauaaagauuggauccuguggauuagcuuugccaucuccugcuuccuucuguguguugcccuccugggguuuauuaugugggcuugccagaagggaaauaucagauguaacauuugcaucuga

SEQ ID NO: 191316 - RNA, 1701 nt, Artificial Sequence; identical to SEQ ID NO: 191291
  derived and/or modified sequence opt5 from hemagglutinin__InfluenzaA__AFD63945

SEQ ID NO: 191317 - RNA, 1701 nt, Artificial Sequence; identical to SEQ ID NO: 191291
  derived and/or modified sequence opt5 from hemagglutinin__InfluenzaA__AFD63956

SEQ ID NO: 191318 - RNA, 1701 nt, Artificial Sequence; identical to SEQ ID NO: 191291
  derived and/or modified sequence opt5 from hemagglutinin__InfluenzaA__AFD63967

SEQ ID NO: 191319 - RNA, 1701 nt, Artificial Sequence; identical to SEQ ID NO: 183097
  derived and/or modified sequence opt5 from hemagglutinin__InfluenzaA__AFD63989

SEQ ID NO: 191320 - RNA, 1701 nt, Artificial Sequence; identical to SEQ ID NO: 183097
  derived and/or modified sequence opt5 from hemagglutinin__InfluenzaA__AFD64000

SEQ ID NO: 191321 - RNA, 1701 nt, Artificial Sequence
  derived and/or modified sequence opt5 from hemagglutinin__InfluenzaA__AFD64011
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccccgggcaaaaucacaguuagcaccaagcgcucccaacagacagugauucccaacaucgggucuagaccucggguccgcgacgugagcuccagaauuagcaucuacuggaccaucgugaagcccggagacauucugcugaucaacucuaccggcaaucucauugcuccucggggguauuucaaaauccgcuccggaaagagcucuauuaugagaagcgaugcccccaucggcaaauguaacuccgagugcaucacaccgaauggcucuauuccuaacgacaagcccuuucagaaugucaaccggaucacguacggggcuuguccucgcuauguuaaacagaauacccugaaacuugccacaggaaugagaaacgugcccgaaaagcaaacccggggcauuuucggggcgaucgccggauuuauugagaauggcugggaagggaugguggauggaugguacggcuuccgccaccagaacagcgagggcacagggcaggcugccgaccugaaguccacccaagcugccaucaaucagaucaacggaaagcucaauagacugauuggcaaaacgaacgagaaguuucaccagaucgaaaaagaguucagcgaagucgaggggcggauucaggaucuugaaaaguauguggaggacacaaaaaucgaucuguggucuuacaaugccgagcuccugguugcucuggaaaaccaacauaccauugaccucaccgauuccgagaugaacaagcuguucgaaagaacaaagaaacagcuucgcgagaaugcggaagacaugggaaacggcugcuuuaagaucuaucacaaaugugauaaugccugcauugggagcauccggaacggcaccuacgaccaugacguguacagagaugaggcucugaauaaccgcuuccagaucaagggagucgagcucaaaucuggcuauaaggacuggauucuguggaucuccuuugccauuagcugcuuccuucuguguguggcccuccugggguuuaucaugugggcuugccagaagggaaauauucggugugauaucugcaucuga

SEQ ID NO: 191322 - RNA, 1701 nt, Artificial Sequence; identical to SEQ ID NO: 183097
  derived and/or modified sequence opt5 from hemagglutinin__InfluenzaA__AFD64022

SEQ ID NO: 191323 - RNA, 1701 nt, Artificial Sequence; identical to SEQ ID NO: 183097
  derived and/or modified sequence opt5 from hemagglutinin__InfluenzaA__AFD64033

SEQ ID NO: 191324 - RNA, 1701 nt, Artificial Sequence
  derived and/or modified sequence opt5 from hemagglutinin__InfluenzaA__AFD64044
augaagaccaucauugcccugagcuacauccucugccugguguucgcucagaaacuucccggcaacgaaaauuccacagccacgcugugucucgggcaccaugcggucccuaacggaaccauuguuaagacaaucaccaaugaccaaauugaagugacaaacgcuaccgagcuggugcagucuagcuccacaggcgggaucugcgauucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucgauuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugacaagcuguauaucuggggagugcaccauccugggacggauucugaccagauuucccucuacgcgcaggccagcggccgcaucacaguuuccaccaaaagaucucaacagacagugauuccgaacaucgggagccggccccgcgucagagauguguccagccggauuucuaucuacuggaccaucgugaagccuggagacauucugcugaucaacuccaccggcaaucucauugcuccccgcggguauuucaagaucagaagcggaaaaucuagcauuaugcgguccgacgccccuaucggcaaguguaacucugaaugcaucacacccaauggcagcauuccgaacgauaaaccuuuucagaaugucaaccgcaucacguacggggcuugucccagauauguuaagcagaauacccugaaacuugccacaggaaugcggaacgugccugagaagcaaacccgcggcauuuucggggcgaucgccggauuuauugaaaauggcugggaggggaugguggacggaugguacggcuucagacaccagaacuccgagggcacagggcaggcugccgaucugaaaagcacccaagcugccaucaaucagaucaacggaaagcucaaucggcugauuggcaagacgaacgaaaaauuucaccagaucgagaaggaguucucugaggucgaagggcgcauucaggaccuugagaaauauguggaggauacaaagaucgaccugugguccuacaaugccgaacuccugguugcucuggagaaccaacauaccauugaucucaccgacagcgaaaugaacaaacuguucgagagaacaaagaagcagcuucgggaaaaugcggaggauaugggaaacggcugcuuuaaaaucuaucacaagugugacaaugccugcauugggucuaucagaaacggcaccuacgaucaugacguguaccgcgacgaggcucugaauaaccgguuccagaucaaaggagucgaacucaaguccggcuauaaagauuggauucuguggaucagcuuugccauuuccugcuuccuucuguguguggcccuccugggguuuaucaugugggcuugccagaagggaaauauuagauguaacaucugcaucuga

SEQ ID NO: 191325 - RNA, 1701 nt, Artificial Sequence; identical to SEQ ID NO: 191301
  derived and/or modified sequence opt5 from hemagglutinin__InfluenzaA__AFD64055

SEQ ID NO: 191326 - RNA, 1701 nt, Artificial Sequence
  derived and/or modified sequence opt5 from hemagglutinin__InfluenzaA__AFD64066
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacacgucucuccggagccugguugcuuccagcggaacccuugaguuuaacaaugaaucuuucaacuggacaggcgugacccagaauggcacauccagcgccugcaagcgcagaucuaacaaguccuuuuucagccggcugaauuggcucacccaucugaaauuuaaguauccugcucuuaacgucacgaugcccaauaacgagaaauucgacaagcuguacaucuggggagugcaccauccugggacagauaacgaccagauuucucucuaugcccaggcguccggccgcaucaccguuagcacaaaaagaucccaacagaccgugauuccgaauaucgggucucggccccgcgucagagaugugccuagccggauuuccaucuacuggaccaucgugaagcccggagacauucugcugaucaacagcacaggcaaucucauugccccucgcggguacuuuaagaucagaucuggaaaauccagcauuaugcggucugacgcucccaucggcaaguguaacagcgagugcaucacgccgaauggcuccauuccuaacgauaaacccuuccagaaugucaaccgcaucaccuauggggccuguccuagauacguuaagcagaauacacugaaacuugcuaccggaaugcggaacgugcccgaaaagcaaacacgcggcauuuuuggggccaucgcgggauucauugagaauggcugggaagggaugguggacggaugguauggcuuuagacaccagaacgccgagggcaccgggcaggcugccgaucugaaaucuacgcaagcugccaucaaucagaucaacggaaagcucaaucggcugauuggcaagacaaacgagaaauuccaccagaucgaaaaggaguucagcgaagucgaggggcgcauucaggaccuugaaaaauacguggaggauaccaagaucgaccugugguccuauaacgccgagcuccugguugcucuggaaaaucaacauaccauugaucucacagacagcgagaugaacaaacuguuugaaagaaccaagaagcagcuucgggagaaugcggaagauaugggaaacggcugcuucaaaaucuaccacaagugugacaaugccugcauugggucuaucagaaacggcacauaugaucaugacguguaccgcgacgaggcucugaauaaccgguuucagaucaaaggagucgagcucaaguccggcuacaaaaauuggauucuguggaucagcuucgccauuucuugcuuucuucuguguguggcccuccugggguucaucaugugggcuugccagaagggaaacauuagauguaauaucugcaucuga

SEQ ID NO: 191327 - RNA, 1701 nt, Artificial Sequence
  derived and/or modified sequence opt5 from hemagglutinin__InfluenzaA__AFD64077
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcaauaagucuuucuucucccggcugaacuggcucacacaucugaaauauaaguacccugcccuuaaugucaccaugcccaacaaugagaaauuugauaagcuguauauuuggggcgugcaccauccugggacggacagcgaucagaucucucucuacgcgcaggccuccggacgcauuacaguuagcaccaaaagaucccaacagacagugaucccgaacauuggcucucggccccgcaucagagacgucagcucccggaucagcauuuacuggaccaucgugaagccuggggacauucugcugaucaacucuaccggaaaucucauugcuccccgcggcuauuucaagaucagauccgggaaaagcucuaucaugcggagcgaugccccuauuggaaaguguaacuccgaaugcaucacacccaauggcucuauuccgaacgacaaaccuuuucagaaugugaaccgcaucacguacggcgcuugucccagauaugucaagcagaauacccugaaacuugccacagggaugcggaacguuccugagaagcaaacccgcggaauuuucggcgcgaucgccggguuuaucgaaaauggaugggagggcaugguggaugggugguacggauucagacaccagaacagcgagggcacaggccaggcugccgaccugaaauccacccaagcugccauuaaucagaucaacgggaagcucaaucggcugauuggaaagacgaacgaaaaauuucaccagaucgagaaggaauuuagcgagguggaaggccgcauucaggaucuugagaaauaugucgaggacacaaagaucgaucuguggucuuacaaugccgaacuccugguggcucuggagaaccaacauaccauugaccucaccgauuccgaaaugaacaaacuguucgagagaacaaagaagcagcuucgggaaaaugcggaggacauggggaacggaugcuuuaaaaucuaucacaagugugauaaugccugcaucggcagcauuagaaacgggaccuacgaccaugacguuuaccgcgaugaggcucugaauaaccgguuccagaucaaaggcguggaacucaagucuggauauaaagacuggauucuguggaucuccuuugccauuagcugcuuccuucugugugucgcccuccugggcuuuaucaugugggcuugccagaaggggaauaucagauguaacauuugcaucuga

SEQ ID NO: 191328 - RNA, 1701 nt, Artificial Sequence; identical to SEQ ID NO: 183097
  derived and/or modified sequence opt5 from hemagglutinin__InfluenzaA__AFD64088

SEQ ID NO: 191329 - RNA, 1701 nt, Artificial Sequence; identical to SEQ ID NO: 183097
  derived and/or modified sequence opt5 from hemagglutinin__InfluenzaA__AFD64099

SEQ ID NO: 191330 - RNA, 1701 nt, Artificial Sequence; identical to SEQ ID NO: 191301
  derived and/or modified sequence opt5 from hemagglutinin__InfluenzaA__AFD64110

SEQ ID NO: 191331 - RNA, 1701 nt, Artificial Sequence
  derived and/or modified sequence opt5 from hemagglutinin__InfluenzaA__AFD64121
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagccgggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagaaagucuaacaaguccuuuuucagccggcugaauuggcucacacaucugaaauauaaguacccugcccuuaacgucaccaugcccaauaacgagaaauuugacaagcuguauaucuggggagugcaccauccugggacggauaacgaccagauuucucucuacgcgcaggccuccggccgcaucacaguuagcaccaaaagaucccaacagacagugauuccgaauaucgggucucggccccgcgucagagaugugagcucccggauuagcaucuacuggaccaucgugaagccuggagacauucugcugaucaacucuaccggcaaucucauugcuccccgcggguauuucaagaucagauccggaaaaagcucuauuaugcggagcgacgccccuaucggcaaguguaacuccgagugcaucacacccaauggcucuauuccgaacgauaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggacggaugguacggcuucagacaccagaacagcgagggcacagggcaggcugccgaucugaaauccacccaagcugccaucaaucagaucaacggaaagcucaaucggcugauuggcaagacgaacgagaaauuucaccagaucgaaaaggaguucagcgaagucgaggggcgcauucaggaccuugaaaaauauguggaggauacaaagaucgaccuguggucuuacaacgccgagcuccugguugcucuggaaaaucaacauaccauugaucucaccgacuccgagaugaacaaacuguucgaaagaacaaagaagcagcuucgggagaaugcggaagauaugggaaacggcugcuuuaaaaucuaucacaagugugacaaugccugcauugggagcaucagaaacggcaccuacgaucaugacguguaccgcgacgaggcucugaauaaccgguuccagaucaaaggagucgagcucaagucuggcuauaaagauuggauucuguggaucuccuuugccauuagcugcuuccuucuguguguggcccuccugggguuuaucaugugggcuugccagaagggaaauauuagauguaacaucugcaucuga

SEQ ID NO: 191332 - RNA, 1701 nt, Artificial Sequence; identical to SEQ ID NO: 183097
  derived and/or modified sequence opt5 from hemagglutinin__InfluenzaA__AFD64132

SEQ ID NO: 191333 - RNA, 1701 nt, Artificial Sequence; identical to SEQ ID NO: 191291
  derived and/or modified sequence opt5 from hemagglutinin__InfluenzaA__AFD64143

SEQ ID NO: 191334 - RNA, 1701 nt, Artificial Sequence; identical to SEQ ID NO: 183097
  derived and/or modified sequence opt5 from hemagglutinin__InfluenzaA__AFD64154

SEQ ID NO: 191335 - RNA, 1701 nt, Artificial Sequence
  derived and/or modified sequence opt5 from hemagglutinin__InfluenzaA__AFD64179
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacgugagcucccagaucagcaucuacuggaccauugugaagccuggagacauccugcugauuaacucuaccggcaaucucaucgcuccccggggguauuucaagauucgcuccggaaaaagcucuaucaugagaagcgaugccccuaucggcaaguguaacuccgagugcauuacacccaauggcucuaucccgaacgacaaaccuuuucagaaugucaaccggauuacguacggggcuuguccccgcuauguuaagcaaaauacccugaaacuugccacaggaaugagaaacgugccugaaaagcagacccggggcaucuucggggcgauugccggauuuaucgagaauggcugggaagggaugguggauggaugguacggcuuccgccaccagaacagcgagggcacagggcaagcugccgaccugaaauccacccaggcugccaucaaucagauuaacggaaagcucaauagacugaucggcaagacgaacgagaaauuucaccagauugaaaaggaguucagcgaagucgaggggcggauccaagaucuugaaaaauauguggaggacacaaagauugaucuguggucuuacaaugccgagcuccugguugcucuggaaaaccagcauaccaucgaccucaccgauuccgagaugaacaaacuguucgaaagaacaaagaagcagcuucgcgagaaugcggaagacaugggaaacggcugcuuuaaaauuuaucacaagugugauaaugccugcaucgggagcauccggaacggcaccuacgaccaugacguguacagagaugaggcucugaauaaccgcuuccagauuaaaggagucgagcucaagucuggcuauaaagacuggauccuguggauuuccuuugccaucagcugcuuccuucuguguguggcccuccugggguuuauuaugugggcuugccaaaagggaaauauccgguguaacaucugcauuuga

SEQ ID NO: 191336 - RNA, 1701 nt, Artificial Sequence; identical to SEQ ID NO: 191335
  derived and/or modified sequence opt5 from hemagglutinin__InfluenzaA__AFD64190

SEQ ID NO: 191337 - RNA, 1701 nt, Artificial Sequence; identical to SEQ ID NO: 191291
  derived and/or modified sequence opt5 from hemagglutinin__InfluenzaA__AFD64201

SEQ ID NO: 191338 - RNA, 1701 nt, Artificial Sequence; identical to SEQ ID NO: 191301
  derived and/or modified sequence opt5 from hemagglutinin__InfluenzaA__AFD64212

SEQ ID NO: 191339 - RNA, 1701 nt, Artificial Sequence
  derived and/or modified sequence opt5 from hemagglutinin__InfluenzaA__AFD64223
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcuccacccugggacggauucugaccagauucgccuguacgcgcaggccuccggcagaaucacaguuagcaccaaacggucccaacagacagugauuccgaacaucgggucucgccccagaguccgggaugugagcucccgcauuagcaucuacuggaccaucgugaagccuggagacauucugcucaucaauucuaccggcaaccugauugcucccagaggguauuucaagauccgguccggaaaaagcucuauuaugcgcagcgacgccccuaucggcaaguguaauuccgagugcaucacacccaacggcucuauuccgaaugauaaaccuuuucagaacgucaauagaaucacguacggggcuuguccccgguauauuaagcagaacacccuuaaacuggccacaggaaugcgcaauguuccugaaaagcaaaccagaggcaucuucggggcgauugccggauuuaucgagaacggcugggaagggaugguggacggaugguacggcuuccggcaucagaauagcgagggcacagggcaggcugccgaucucaaauccacccaagcugccaucaaccagauuaauggaaagcugaacagacuuaucggcaagacgaaugagaaauuucaccagauugaaaaggaguucagcgaaguggaggggcgcauccaggaccuggaaaaauaugucgaggauacaaagauugaccucuggucuuacaacgccgagcugcugguggcucucgaaaaccaauauaccaucgaucugaccgacuccgagaugaauaaacuuuucgaacggacaaagaagcagcugagagagaacgcggaagauaugggaaauggcugcuuuaaaauuuaccacaagugugacaacgccugcaucgggagcauccgcaauggcaccuacgaucaugacguuuaucgggacgaggcucucaacaauagauuccagauuaaaggaguggagcugaagucuggcuacaaagauuggauccuuuggauuuccuuugccaucagcugcuuccugcucugugucgcccugcugggguuuauuaugugggcuugccagaagggaaacauccgcuguaauaucugcauuuga

SEQ ID NO: 191340 - RNA, 1701 nt, Artificial Sequence
  derived and/or modified sequence opt5 from hemagglutinin__InfluenzaA__AFD64315
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguauuucaagauuagauccggaaaaagcucuaucaugcggagcgaugccccuaucggcaaguguaacuccgagugcauuacacccaauggcucuaucccgaacgacaaaccuuuucagaaugucaaccgcauuacguacggggcuugucccagauauguuaagcagaauacccugaaacuugccacaggaaugcggaacgugccugaaaagcaaacccgcggcaucuucggggcgauugccggauuuaucgagaauggcugggaagggaugguggauggaugguacggcuucagacaccagaacagcgagggcacagggcaggcugccgaccugaaauccacccaagcugccaucaaucagauuaacggaaagcucaaucggcugaucggcaagacgaacgagaaauuucaccagauugaaaaggaguucagcgaagucgaggggagaauccaggaucuugaaaaauauguggaggacacaaagauugaucuguggucuuacaaugccgagcuccugguugcucuggaaaaccaacauaccaucgaccucaccgauuccgagaugaacaaacuguucgaacgcacaaagaaucagcuucgggagaacgcggaagacaugggaaauggcugcuuuaagauuuaucacaaaugugauaacgccugcaucgggagcaucagaaauggcaccuacgaccaugacguguaccgcgaugaggcucugaacaaucgguuccagauuaagggagucgagcucaaaucuggcuauaaggacuggauccuguggauuuccuuugccaucagcugcuuccuucuguguguggcccuccugggguuuauuaugugggcuugccagaaaggaaacaucagauguaauaucugcauuuga

SEQ ID NO: 191341 - RNA, 1701 nt, Artificial Sequence; identical to SEQ ID NO: 191331
  derived and/or modified sequence opt5 from hemagglutinin__InfluenzaA__AFD64326

SEQ ID NO: 191342 - RNA, 1701 nt, Artificial Sequence; identical to SEQ ID NO: 191301
  derived and/or modified sequence opt5 from hemagglutinin__InfluenzaA__AFD64337

SEQ ID NO: 191343 - RNA, 1701 nt, Artificial Sequence; identical to SEQ ID NO: 183097
  derived and/or modified sequence opt5 from hemagglutinin__InfluenzaA__AFD64348

SEQ ID NO: 191344 - RNA, 1701 nt, Artificial Sequence; identical to SEQ ID NO: 191301
  derived and/or modified sequence opt5 from hemagglutinin__InfluenzaA__AFD64359

SEQ ID NO: 191345 - RNA, 1701 nt, Artificial Sequence
  derived and/or modified sequence opt5 from hemagglutinin__InfluenzaA__AFD64370
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccauugcgacggguuucagaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacaaaauggcaccuccagcgcuugcaagcgcaagucuaacaaauccuuuuucagcagacugaauuggcucacacaccugaaguauaaauacccugcccuuaacgucaccaugcccaauaacgagaaguuugacaaacuguauaucuggggagugcaucacccugggacggauaacgaccagauuucucucuacgcgcaggccuccggccggaucacaguuagcaccaagcgcucccagcaaacagugauuccgaauaucgggucuagaccccggguccgcgauauuagcuccagaaucagcaucuacuggaccauugugaagccuggagacauccugcugauuaacucuaccggcaaucucaucgcuccccggggguauuucaaaauucgcuccggaaagagcucuaucaugagaagcgacgccccuaucggcaaauguaacuccgagugcauuacacccaauggcucuaucccgaacgauaagccuuuucagaaugugaaccggauuacguacggggcuuguccccgcuaugucaaacagaauacccugaaacuugccacaggaaugagaaacguuccugaaaagcagacccggggcaucuucggggcgauugccggauuuaucgagaauggcugggaagggaugguggacggaugguacggcuuccgccaccaaaacagcgagggcacagggcaggcugccgaucugaaguccacccaggcugccaucaaucaaauuaacggaaagcucaauagacugaucggcaaaacgaacgagaaguuucaucagauugaaaaagaguucagcgaaguggaggggcggauccaggaccuugaaaaguaugucgaggauacaaaaauugaccuguggucuuacaacgccgagcuccugguggcucuggaaaaucagcacaccaucgaucucaccgacuccgagaugaacaagcuguucgaaagaacaaagaaacaacuucgcgagaaugcggaagauaugggaaacggcugcuuuaagauuuaucauaaaugugacaaugccugcaucgggagcauccggaacggcaccuacgaucacgacguuuacagagacgaggcucugaauaaccgcuuccagauuaagggaguggagcucaaaucuggcuauaaggauuggauccuguggauuuccuuugccaucagcugcuuccuucugugugucgcccuccugggguuuauuaugugggcuugccagaagggaaauauccgguguaacaucugcauuuga

SEQ ID NO: 191346 - RNA, 1701 nt, Artificial Sequence; identical to SEQ ID NO: 183097
  derived and/or modified sequence opt5 from hemagglutinin__InfluenzaA__AFD64381

SEQ ID NO: 191347 - RNA, 1701 nt, Artificial Sequence; identical to SEQ ID NO: 191301
  derived and/or modified sequence opt5 from hemagglutinin__InfluenzaA__AFD64392

SEQ ID NO: 191348 - RNA, 1701 nt, Artificial Sequence; identical to SEQ ID NO: 191291
  derived and/or modified sequence opt5 from hemagglutinin__InfluenzaA__AFD64403

SEQ ID NO: 191349 - RNA, 1701 nt, Artificial Sequence; identical to SEQ ID NO: 191291
  derived and/or modified sequence opt5 from hemagglutinin__InfluenzaA__AFD64414

SEQ ID NO: 191350 - RNA, 1701 nt, Artificial Sequence
  derived and/or modified sequence opt5 from hemagglutinin__InfluenzaA__AFD64425
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccaacuacgcuucccuccggucucugguugccagcuccggaacgcuugaguuuaauaacgaaucuuucgauuggaccggcgugacacagaauggcaccucuuccgcuugcaagcgcagaagcaacaagagcuuuuucucccggcugaauuggcucacacaucugaaauauaaguacccugcccuuaacgucaccaugcccaauaacgagaaauuugacaagcuguauauuuggggagugcaccauccugggacggauagcgaccagaucucucucuacgcgcaggccuccggccgcauuacaguuagcaccaaaagaucccaacagacagugaucccgaacauugggucucggccccgcgucagagaugugagcucccggaucagcaucuacuggaccauugugaagccuggagacauccugcugauuaauucuaccggcaaccucaucgcuccccgcggguauuucaagauuagauccggaaaaagcucuaucaugcggagcgacgccccuaucggcaaguguaauuccgagugcauuacacccaacggcucuaucccgaaugauaaaccuuuucagaacgucaaucgcauuacguacggggcuugucccagauauguuaagcagaacacccugaaacuugccacaggaaugcggaaugugccugaaaagcaaacccgcggcaucuucggggcgauugccggauuuaucgagaacggcugggaagggaugguggacggaugguacggcuucagacaccagaauagcgagggcacagggcaggcugccgaucugaaauccacccaagcugccaucaaccagauuaauggaaagcucaaccggcugaucggcaagacgaaugagaaauuucaccagauugaaaaggaguucagcgaagucgaggggagaauccaggaccuugaaaaauauguggaggauacaaagauugaccuguggucuuacaacgccgagcuccugguugcucuggaaaaccaacauaccaucgaucucaccgacuccgagaugaauaaacuguucgaacgcacaaagaagcagcuucgggagaacgcggaagauaugggaaauggcugcuuuaaaauuuaucacaagugugacaacgccugcaucgggagcaucagaaauggcaccuacgaucauaacguguaccgcgacgaggcucugaauaaccgguuccagauuaaaggagucgagcucaagucuggcuauaaagacuggauccuguggauuuccuuugccaucagcugcuuccuucuguguguggcccuccugggguuuauuaugugggcuugccagaagggaaauaucagauguaacaucugcauuuga

SEQ ID NO: 191351 - RNA, 1701 nt, Artificial Sequence; identical to SEQ ID NO: 183097
  derived and/or modified sequence opt5 from hemagglutinin__InfluenzaA__AFD64436

SEQ ID NO: 191352 - RNA, 1701 nt, Artificial Sequence; identical to SEQ ID NO: 183097
  derived and/or modified sequence opt5 from hemagglutinin__InfluenzaA__AFD64447

SEQ ID NO: 191353 - RNA, 1701 nt, Artificial Sequence
  derived and/or modified sequence opt5 from hemagglutinin__InfluenzaA__AFD64458
augaagaccaucauugcccugagcuacauccucugccugguguucgcucagaaacuucccggcaacgacaauuccacagccacgcugugucucgggcaccaugcgguccaaaacggaaccauuguuaagacaaucaccaaugaucagauugaggugacaaacgcuaccgaacuggugcagucuagcuccacaggcgggaucugcgacucuccucaccagauccuugauggagagaauuguacccugauugacgcccuccugggcgauccgcaaugcgacggguuucagaacaaaaagugggaucuguucgucgaaagaagcaaagccuauuccaauuguuaccccuaugacgugccugauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguaccccgcccuuaaugucaccaugccuaacaaugagaaauuugauaagcuguauaucuggggagugcaccaucccgggacggacucugaucagauuucccucuacgcgcaagccagcggccgcaucacaguuuccaccaaaagaucucagcagacagugauuccuaacaucgggagccggccgcgcgucagagacguguccagccggauuucuaucuacuggaccaucgugaagcccggagacauucugcugaucaacuccaccggcaaucucauugcuccucgcggguauuucaagaucagaagcggaaaaucuagcauuaugcgguccgaugcccccaucggcaaguguaacucugagugcaucacaccuaauggcagcauucccaacgacaaaccguuucagaaugucaaccgcaucacguacggggcuuguccuagauauguuaagcaaaauacccugaaacuugccacaggaaugcggaacgugcccgaaaagcagacccgcggcauuuucggggcgaucgccggauuuauugagaauggcugggaagggaugguggauggaugguacggcuucagacaccagaacuccgagggcacagggcaagcugccgaccugaaaagcacccaggcugccaucaaucagaucaacggaaagcucaaucggcugauuggcaagacgaacgagaaauuucaccagaucgaaaaggaguucucugaagucgaggggcgcauucaagaucuugaaaaauauguggaggacacaaagaucgaucugugguccuacaaugccgagcuccugguugcucuggaaaaccagcauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaagacuggauucuguggaucagcuuugccauuuccugcuuccuucuguguguggcccuccugggguuuaucaugugggcuugccaaaagggaaauauuagauguaacaucugcaucuga

SEQ ID NO: 191354 - RNA, 1701 nt, Artificial Sequence; identical to SEQ ID NO: 189879
  derived and/or modified sequence opt5 from hemagglutinin__InfluenzaA__AFD64795

SEQ ID NO: 191355 - RNA, 1701 nt, Artificial Sequence; identical to SEQ ID NO: 190006
  derived and/or modified sequence opt5 from hemagglutinin__InfluenzaA__AFD64799

SEQ ID NO: 191356 - RNA, 1701 nt, Artificial Sequence
  derived and/or modified sequence opt5 from hemagglutinin__InfluenzaA__AFD64802
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucauaagugugauaaugccugcauuggcucuaucagaaacgggacauacgaccacgauguguaucgcgacgaggcccugaauaaccgguuccagaucaaaggcgucgagcucaaguccgaauacaaagacuggauucuguggaucagcuuugcuauuucuugcuuccuucuguguguggcccuccugggauuuaucaugugggcgugccaaaagggcaauauuagauguaacaucugcaucuga

SEQ ID NO: 191357 - RNA, 1701 nt, Artificial Sequence
  derived and/or modified sequence opt5 from hemagglutinin__InfluenzaA__AFD64804
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugauggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaaguggagggccgcauccaagaucuugaaaaguaugucgaggacaccaaaauugaucugugguccuacaacgcggagcuccugguggcccuggaaaaucagcacacgaucgaccucacagauagcgagaugaacaagcuguucgaaaagaccaagaaacagcuucgggagaaugcugaagacauggggaacggaugcuuuaagauuuaucauaagugugauaaugccugcaucggcucuaucagaaacgggaccuacgaccacgauguuuaucgcgacgaggcccugaauaaccgguuccagauuaaaggcguggagcucaaguccggauacaaagacuggauccuguggauuagcuuugcuaucucuugcuuccuucugugugucgcccuccugggcuuuauuaugugggcgugccaaaaggggaauaucagauguaacaucugcauuuga

SEQ ID NO: 191358 - RNA, 1701 nt, Artificial Sequence
  derived and/or modified sequence opt5 from hemagglutinin__InfluenzaA__AFD64806
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucauaagugugauaaugccugcauuggcucuaucagaaacgggacauacgaccacgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauauuagauguaacaucugcaucuga

SEQ ID NO: 191359 - RNA, 1701 nt, Artificial Sequence
  derived and/or modified sequence opt5 from hemagglutinin__InfluenzaA__AFD64807
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagagacauuccuucucgggugagcaucuauuggaccaucgugaaacccggggauauucugcugaucaacuccaccggaaaucucauugccccucgcggcuacuucaagaucagaagcgggaaaucuuccauuaugcggagcgacgcuccccugggaaagugucacucugccugcaucacaccgaacggcagcaucccuaaugacaagcccuuucagaacgucaaucgcauuacguacggcgcguguccuagauauguuaaacaaaacacccuuaagcuggccacagggaugcggaaugugcccgaaaaacagacccgcggaaucuucggcgcuauugccggguuuaucgagaacggaugggaaggcaugguggaugggugguacggauucagacaucaaaauuccgagggccggggccaggcugccgaccucaagucuacacaggccgcuauugaucagaucaacgggaaacugaauagacuuaucggaaagaccaacgagaaauuccaccagauugaaaaggaguuuagcgaagucgagggccgcauccaagaccuggaaaaguauguggaggauacgaaaauugaccucugguccuacaacgcggagcugcugguugcccucgaaaaucagcauacaaucgaucugaccgacagcgagaugaacaaacuuuucgaaaagaccaagaaacagcugcgggagaaugcugaagauauggggaacggaugcuuuaagauuuaucacaagugugacaaugccugcaucggcucuauuagaaacgggacauacgaucacgacauguaucgcgacgaggcccucaauaaccgguuccagaucaaaggcguggagcugaaguccggauacaaagauuggauccuuuggauuagcuuugcuaucucuugcuuccugcucugugucgcccugcugggcuuuauuaugugggcgugccaaaaggggaauaucagauguaacauuugcaucuga

SEQ ID NO: 191360 - RNA, 1701 nt, Artificial Sequence
  derived and/or modified sequence opt5 from hemagglutinin__InfluenzaA__AFD64810
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugguggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaagucgagggccgcauccaagaucuugaaaaguauguggaggacaccaaaauugaucugugguccuacaacgcggagcuccugguugcccuggaaaaucagcacacgaucgaccucacagauagcgagaugaacaagcuguucgaaaagaccaagaaacagcuucgggagaaugcugaagacauggggaacggaugcuuuaagauuuaucauaagugugauaaugccugcaucggcucuaucagaaacgggaccuacgaccccgauguguaucgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 191361 - RNA, 1701 nt, Artificial Sequence
  derived and/or modified sequence opt5 from hemagglutinin__InfluenzaA__AFD64812
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaccgaccagaucaacgggaaacucaacagacugaucggaaagacgaaugagaaauuccaucagauugaaaaggaguuuagcgaagucgagggccgcauccaagaucuugaaaaguauguggaggacacaaaaauugaucugugguccuacaacgcggagcuccugguugcccuggaaaaucagcacaccaucgaccucaccgauagcgagaugaacaagcuguucgaaaagacaaagaaacagcuucgggagaaugcugaagacauggggaacggaugcuuuaagauuuaucauaagugugauaaugccugcaucggcucuauuagaaacgggaccuacgaccacgauguguaucgcgacgaggcccugaauaaccgguuccagaucaaaggcgucgagcucaaguccggauacaaagacuggauccuguggauuagcuuugcuaucucuugcuuccuucuguguguggcccuccugggcuuuauuaugugggcgugccaaaaggggaauaucagauguaacauuugcaucuga

SEQ ID NO: 191362 - RNA, 1701 nt, Artificial Sequence
  derived and/or modified sequence opt5 from hemagglutinin__InfluenzaA__AFD64814
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucauaagugugauaaugccugcauuggcucuaucagaaacgggacauacgaccccgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauauuagauguaacaucugcaucuga

SEQ ID NO: 191363 - RNA, 1701 nt, Artificial Sequence
  derived and/or modified sequence opt5 from hemagglutinin__InfluenzaA__AFD64816
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcaauucuccgcaccagauccuugacggcgagaacuguacccugauugaugcccuccugggggacccccagugcgauggauuucaaaauaaaaagugggaccuguucgucgaaagaagcaaagcccauuccaacuguuauccuuacgaugugcccgacuaugcuucucuccggagccugguugccuccagcggcacgcuugaguuuaauaacgagucuuucaauuggaccggggugacacagaacggaaccuccagcgcuugcaugcgcagaucuaauaacuccuuuuucagccggcugaauuggcucacacaccugaacuuuaaguacccugcccuuaacgucaccaugcccaauaacgaacaguucgauaagcuguauaucuggggcgugcaucacccuggcacggacaaagaucagauuuuucucuacgcgcaagccucugggcgcaucacaguuuccaccaagagaagccagcaggcugugauuccgaauaucggaucccggccccgcgucagaaacauuccuucucgggugagcaucuauuggacaaucgugaaacccggcgacauucugcugaucaauuccaccgggaaccucauugccccucgcggauacuucaagaucagaagcggcaaaucuuccauuaugcggagcgaugcucccaucgggaaguguaauucugccugcaucaccccgaacggaagcauuccuaaugacaagcccuuucagaacgucaaucgcaucacauacggcgcguguccuagauauguuaaacaaaacacgcugaaacuugccaccggcaugcggaaugugcccgagaagcagacacgcgggauuuucggagcuaucgccggcuuuauugaaaacgggugggagggaaugguggacggcugguacggguucagacaccaaaauuccgagggacggggccaggcugccgaucugaagucuacccaggccgcuaucgaccagaucaacggcaaacucaacagacugauugggaagacaaaugaaaaauuccaucagaucgagaaggaauuuagcgaggucgaaggacgcauucaagaucuugagaaguauguggaggacaccaaaaucgaucugugguccuacaacgcggaacuccugguugcccuggagaaucagcacacgauugaccucacagauagcgaaaugaacaagcuguucgagaaaaccaagaaacagcuucgggaaaaugcugaggacaugggcaacgggugcuuuaagaucuaucauaagugugauaaugccugcauuggaucuaucagaaacggcaccuacgaccacgauguguaucgcgacgaggcccugaauaaccgguuccagaucaaaggggucgaacucaaguccggcuacaaagacuggauucuguggaucagcuuugcuauuucuugcuuccuucuguguguggcccuccugggauuuaucaugugggcgugccaaaagggcaauauuagauguaacaucugcaucuga

SEQ ID NO: 191364 - RNA, 1701 nt, Artificial Sequence
  derived and/or modified sequence opt5 from hemagglutinin__InfluenzaA__AFD64818
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcuccccugggaaaguguaucucugccugcaucacaccgaauggcagcauuccuaacgacaagcccuuucagaaugucaaccgcaucacguacggcgcguguccuagauauguuaaacaaaauacccuuaagcuggccacagggaugcggaacgugcccgaaaaacagacccgcggaauuuucggcgcuaucgccggguuuauugagaauggaugggaaggcaugguggacgggugguacggauucagacaccagaacuccgagggccggggccaagcugccgaucucaagucuacacaggccgcuaucgaccagaucaaugggaaacugaacagacuuauuggaaagaccaacgagaaauuccaucagaucgaaaaggaguuuagcgaagucgagggccgcauucaagaucuggaaaaguauguggaggacacgaaaaucgaucucugguccuacaaugcggagcugcugguugcccucgaaaaccagcacacaauugaccugaccgauagcgagaugaauaaacuuuucgaaaagaccaagaaacagcugcgggagaacgcugaagacauggggaauggaugcuuuaagaucuaucauaagugugauaacgccugcauuggcucuaucagaaaugggacauacgaccacgauguguaucgcgacgaggcccucaacaaucgguuccagaucaaaggcgucgagcugaaguccggauacaaagacuggauucuuuggaucagcuuugcuauuucuugcuuccugcucuguguggcccugcugggcuuuaucaugugggcgugccaaaaggggaacauuagauguaauaucugcaucuga

SEQ ID NO: 191365 - RNA, 1701 nt, Artificial Sequence
  derived and/or modified sequence opt5 from hemagglutinin__InfluenzaA__AFD64819
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcauuagaaacaucccuucucgggucagcaucuauuggaccauugugaaacccggggacauccugcugauuaauuccaccggaaaccucaucgccccucgcggcuacuucaagauuagaagcgggaaaucuuccaucaugcggagcgaugcucccaucggaaaguguauuucugccugcaucacaccgaauggcagcauuccuaacgacaagcccuuucagaaugugaaccgcaucacguacggcgcguguccuagauaugucaaacaaaauacccugaaacuugccacagggaugcggaacguucccgaaaaacagacccgcggaauuuucggcgcuaucgccggguuuaucgagaauggaugggaaggcaugguggacgggugguacggauucagacaccagaacuccgagggccggggccaagcugccgaucugaagucuacacaggccgcuauugaccagaucaaugggaaacucaacagacugauuggaaagaccaacgagaaauuccaucagaucgaaaaggaguuuagcgaaguggagggccgcauucaagaucuugaaaaguaugucgaggacacgaaaaucgaucugugguccuacaaugcggagcuccugguggcccuggaaaaccagcacacaauugaccucaccgauagcgagaugaauaagcuguucgaaaagaccaagaaacagcuucgggagaacgcugaagacauggggaauggaugcuuuaagaucuaucauaagugugauaacgccugcaucggcucuauuagaaaugggacauacgaccccgauguuuaucgcgacgaggcccugaacaaucgguuccagaucaaaggcguggagcucaaguccggauacaaagacuggauucuguggaucagcuuugcuauuucuugcuuccuucugugugucgcccuccugggcuuuaucaugugggcgugccaaaaggggaacaucagauguaauauuugcaucuga

SEQ ID NO: 191366 - RNA, 1701 nt, Artificial Sequence; identical to SEQ ID NO: 190006
  derived and/or modified sequence opt5 from hemagglutinin__InfluenzaA__AFD64820

SEQ ID NO: 191367 - RNA, 1701 nt, Artificial Sequence
  derived and/or modified sequence opt5 from hemagglutinin__InfluenzaA__AFD64822
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcaugcgcagaucuaauaacuccuuuuucagccggcugaauuggcucacacaccugaacuuuaaguacccugcccuuaacgucaccaugcccaauaacgagcaguucgauaagcuguauaucuggggcgugcaucacccugggacggacaaagaucagauuuuucucuacgcgcaagccucuggacgcaucacaguuuccaccaagagaagccagcaggcugugauuccgaauaucggcucccggccccgcgucagaaacauuccuucucgggugagcaucuauuggacaaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucaccccgaacggcagcauuccuaaugacaagcccuuucagaacgucaaucgcaucacauacggcgcguguccuagauauguuaaacaaaacacgcugaaacuugccaccgggaugcggaaugugcccgaaaaacagacacgcggaauuuucggcgcuaucgccggguuuauugagaacggaugggaaggcaugguggacgggugguacggauucagacaccaaaauuccgagggccggggccaggcugccgaucugaagucuacccaggccgcuaucgaccagaucaacgggaaacucaacagacugauuggaaagacaaaugagaaauuccaucagaucgaaaaggaguuuagcgaagucgagggccgcauucaagaucuugaaaaguauguggaggacaccaaaaucgaucugugguccuacaacgcggagcuccugguugcccuggaaaaucagcacacgauugaccucacagauagcgagaugaacaagcuguucgaaaagaccaagaaacagcuucgggagaaugcugaagacauggggaacggaugcuuuaagaucuaucauaagugugauaaugccugcauuggcucuaucagaaacgggaccuacgaccacgauguguaucgcgacgaggcccugaauaaccgguuccagaucaaaggcgucgagcucaaguccggauacaaagacuggauucuguggaucagcuuugcuauuucuugcuuccuucuguguguggcccuccugggcuuuaucaugugggcgugccaaaaggggaauauuagauguaacaucugcaucuga

SEQ ID NO: 191368 - RNA, 1701 nt, Artificial Sequence
  derived and/or modified sequence opt5 from hemagglutinin__InfluenzaA__AFD64823
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggacgcuguaauagcgcgugcauuaccccgaacggcucuaucccuaaugacaagcccuuucagaacgucaauagaauuacauacggcgccuguccucgguauguuaagcaaaacacgcugaaacuugcuaccgggaugcgcaaugugcccgaaaagcagacaagaggaaucuucggcgccauugcuggguuuaucgagaacggaugggaaggcaugguggacgggugguacggauuccggcaccagaauagcgagggcagaggccaagccgccgaucugaaauccacccaggcugcgaucgaccagauuaacgggaagcucaaccgccugaucggaaaaacaaaugagaaguuccaucagauugaaaaagaguuuucugaagucgagggccggauccaagaucuugaaaaguauguggaggacaccaagauugaucuguggagcuacaacgccgagcuccugguugcucuggaaaaucagcacacgaucgaccucacagauuccgagaugaacaaacuguucgaaaagaccaaaaagcagcuuagagagaaugccgaagacauggggaacggaugcuuuaaaauuuaucauaagugugauaaugccugcaucggcagcauccgcaacgggaccuacgaccacgauguguaucgggacgaggcucugaauaacagauuccagauuaagggcgucgagcucaaaucuggauacaaggacuggauccuguggauuuccuuugccaucagcugcuuccuucuguguguggcgcuccugggcuuuauuaugugggcuugccaaaaagggaauauccgcuguaacaucugcauuuga

SEQ ID NO: 191369 - RNA, 1701 nt, Artificial Sequence
  derived and/or modified sequence opt5 from hemagglutinin__InfluenzaA__AFD64824
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucauaagugugauaaugccugcauuggcucuaucagaaacgggacauacgaccacgauguguaucgcgacgaggcccugaauaaccgguuccagaucaaaggcgucgagcucaaguccggauacaaagacuggauucuguggaucagcuuugcuaccucuugcuuccuucuguguguggcccuccugggcuuuauuaugugggcgugccaaaaggggaauaucagauguaacauuugcaucuga

SEQ ID NO: 191370 - RNA, 1701 nt, Artificial Sequence; identical to SEQ ID NO: 191358
  derived and/or modified sequence opt5 from hemagglutinin__InfluenzaA__AFD64825

SEQ ID NO: 191371 - RNA, 1701 nt, Artificial Sequence; identical to SEQ ID NO: 191358
  derived and/or modified sequence opt5 from hemagglutinin__InfluenzaA__AFD64827

SEQ ID NO: 191372 - RNA, 1701 nt, Artificial Sequence
  derived and/or modified sequence opt5 from hemagglutinin__InfluenzaA__AFD64828
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaaacagacacgcggaaucuucggcgcuauugccggguuuaucgagaacggaugggaaggcaugauggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaaguggagggccgcauccaagaucuugaaaaguaugucgaggacaccaaaauugaucugugguccuacaacgcggagcuccugguggcccuggaaaaucagcacacgaucgaccucacagauagcgagaugaacaagcuguucgaaaagaccaagaaacagcuucgggagaaugcugaagacauggggaacggaugcuuuaagauuuaucauaagugugauaaugccugcaucggcucuaucagaaacgggaccuacgaccccgauguuuaucgcgacgaggcccugaauaaccgguuccagauuaaaggcguggagcucaaguccggauacaaagacuggauccuguggauuagcuuugcuaucucuugcuuccuucugugugucgcccuccugggcuuuauuaugugggcgugccaaaaggggaauaucagauguaacaucugcauuuga

SEQ ID NO: 191373 - RNA, 1701 nt, Artificial Sequence; identical to SEQ ID NO: 191367
  derived and/or modified sequence opt5 from hemagglutinin__InfluenzaA__AFD64830

SEQ ID NO: 191374 - RNA, 1701 nt, Artificial Sequence; identical to SEQ ID NO: 190006
  derived and/or modified sequence opt5 from hemagglutinin__InfluenzaA__AFD98095

SEQ ID NO: 191375 - RNA, 1701 nt, Artificial Sequence
  derived and/or modified sequence opt5 from hemagglutinin__InfluenzaA__AFD98106
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgcccuggagaaucaacacaccauugaucucacggacucugaaaugaacaaacuguucgagaagaccaaaaagcagcuuagagaaaaugcugaggauauggggaacggaugcuuuaaaaucuaccauaagugugacaaugccugcaucggcuccauucgcaacgggacauaugaucacgacguguaccgggacgaggcccugaauaacagauuccagaucaagggcguugaacucaaaagcggauacaaggauuggauucuguggaucucuuuugcuauuuccugcuuccuucuguguguggcccuccugggcuuuaucaugugggcgugccagaaagggaauauccgcuguaacauuugcaucuga

SEQ ID NO: 191376 - RNA, 1701 nt, Artificial Sequence
  derived and/or modified sequence opt5 from hemagglutinin__InfluenzaA__AFD98128
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcaacuccccgcaccagauccuugacggggaaaauuguacccugauugaugcccuccugggagacccccagugcgauggcuuucagaacaaaaagugggaccuguucgucgagagaucuaaagcccauagcaauuguuauccuuacgaugugcccgacuaugcuucccuccggucucugguugccagcuccgggacgcuugaauuuaacaaugagagcuucaacuggaccggagugacacagaauggcaccucuuccgcuugcauccgcaagagcaacaauuccuuuuucucuagacugaacuggcucacacaccugaacuuuaaguacccugcccuuaaugucaccaugcccaacaaugagcaguucgauaaacuguauauuuggggcgugcaucacccugggacggacaaggaucagaucuuucucuacgcgcaagccgcuggacggauuacaguuagcaccaaacgcucucagcaggccgugaucccgaacauuggcuccagaccccggguccgcaauaucccuagcagaguguccaucuauuggacaauugugaagcccggggacauccugcugauuaacucuaccggaaaucucaucgcuccucggggcuacuucaaaauucgcagcgggaaguccagcaucaugagaucugaugcccccaucggaaaguguaacuccgcgugcauuaccccgaauggcagcaucccuaacgacaaacccuuucagaaugucaaccggauuacauacggcgccuguccucgcuauguuaagcaaaauacgcugaaacuugcuaccgggaugagaaacgugcccgaaaagcagacacggggaaucuucggcgccauugcuggguuuaucgagaauggaugggaaggcaugguggacgggugguacggauuccgccaccagaacucugagggcagaggccaagccgccgaucugaaaagcacccaggcugcgaucgaccagauuaacgggaagcucaaucggcugaucggaaaaacaaacgagaaguuccaucagauugaaaaggaguuuuccgaagucgagggcagaauccaagaucuugaaaaauauguggaggacaccaagauugaucuguggucuuacaaugccgagcuccugguugcucuggaaaaccagcacacgaucgaccucacagauagcgagaugaauaaacuguucgaaaagaccaaaaagcagcuucgcgagaacgccgaagacauggggaauggaugcuuuaagauuuaucauaaaugugauaacgccugcaucggcuccauccggaaugggaccuacgaccacgauguguauagagacgaggcucugaacaaucgcuuccagauuaagggcgucgagcucaaaagcggauacaaggacuggauccuguggauuucuuuugccaucuccugcuuccuucuguguguggcgcuccugggcuuuauuaugugggcuugccaaaaagggaacauccgguguaauaucugcauuuga

SEQ ID NO: 191377 - RNA, 1701 nt, Artificial Sequence; identical to SEQ ID NO: 190006
  derived and/or modified sequence opt5 from hemagglutinin__InfluenzaA__AFD98139

SEQ ID NO: 191378 - RNA, 1701 nt, Artificial Sequence
  derived and/or modified sequence opt5 from hemagglutinin__InfluenzaA__AFD98161
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcgccggcgagaucugcgacuccccgcaccauauccuugauggggaaaacuguacacugauugacgcccuccugggagauccccagugcgacggcuuucagaauaaaaagugggaucuguucgucgagagaucucgggcuuauagcaacuguuacccuuaugacgugcccgauuacgccucccuccgcucucugguugcuagcuccgggacccuugaauuuaauaacgagagcuucaauuggacgggagugacccagaacggcacaucuuccgccugcaucagacggagcaauaacuccuuuuucucucgccugaauuggcucacccaccugaacuuuaaauauccugcgcuuaacgucacaaugcccaauaacgagcaguucgacaagcuguacauuuggggcgugcaucacccugggaccgauaaggaccagaucuuucucuaugcccaggcuagcggaagaauuacgguuucuacaaaacggucccaacaggccgugaucccgaauauuggcagccgccccagaguccggaacaucccuucccgcaucucuauuuacuggaccaucgugaagcccggggauauucugcugaucaauagcacaggaaaccucauugcuccuagaggcuacuucaaaauccgguccgggaaaagcucuaucaugcgcuccgacgcccccauuggaaaauguaauagcgaaugcaucaccccgaacggcucuauuccuaaugacaagcccuuucagaacgugaauagaaucaccuauggcgcguguccucgguacgucaagcagagcacacugaaacuugccacggggaugcgcaacguucccgagaagcaaaccagaggaauuuucggcgcuaucgccggguuuaucgaaaauggaugggagggcaugauggaugggugguauggauuccggcaccagaacuccgagggcagaggccaggcugccgaccugaaaucuacacaagccgcuauugaucagaucaaugggaagcucaaccgccugauuggaaaaaccaacgaaaaguuccaucagaucgagaaagaauuuagcgagguggaaggccggauucaggaccuugagaaguacguggaggauacaaagaucgaccugugguccuauaaugcggaacuccuggucgcccuggagaaccaacacaccauugaucucacggacagcgaaaugaauaaacuguucgagaagacaaagaagcagcuuagagaaaacgcugaggauauggggaauggaugcuuuaaaaucuaccauaagugugacaacgccugcaucggcucuauucgcaaugggaccuaugaucacgacguguaccgggacgaggcccugaacaauagauuccagaucaagggcguugaacucaaauccggauacaaggauuggauucuguggaucagcuuugcuauuucuugcuuccuucuguguguggcccuccugggcuuuaucaugugggcgugccagaaagggaacauccgcuguaauauuugcaucuga

SEQ ID NO: 191379 - RNA, 1701 nt, Artificial Sequence
  derived and/or modified sequence opt5 from hemagglutinin__InfluenzaA__AFD98172
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgcccuggagaaucaacacaccauugaucucacggacucugaaaugaacaaacuguucgagaagaccaaaaagcagcuuagagaaaaugcugaggauauggggaacggaugcuuuaaaaucuaccauaagugugacaaugccugcaucggcuccauucgcaacgggacauaugaucacgacguguaccgggacgaggcccugaauaacagauuccagaucaagggcguugaacucaaaagcggauacaaggauugggugcuguggauuucuuuugcuaucuccugcuuccuucugugugucgcccuccugggcuuuauuaugugggcgugccagaaagggaauauccgcuguaacaucugcauuuga

SEQ ID NO: 191380 - RNA, 1701 nt, Artificial Sequence
  derived and/or modified sequence opt5 from hemagglutinin__InfluenzaA__AFD98183
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugcugccgaauaucggcucccggccccgcgucagaaacauuccuucucgggugagcaucuauuggacaaucgugaaacccggggacauucugcucaucaauuccaccggaaaccugauugccccucgcggcuacuucaagaucagaagcgggaaaucuuccauuaugcggagcgaugcucccaucggaaaguguaauucuaccugcaucacaccgaacggcagcauuccuaaugacaagcccuuucagaacgucaaucgcaucacguacggcgccuguccuagauauguuaaacaaaacacccuuaagcuggcgacagggaugcggaaugugcccgaaaaacagacccgcggaauuuucggcgccaucgcuggguuuauugagaacggaugggaaggcaugguggacgggugguacggauucagacaccaaaauuccgagggccggggccaggccgcugaucucaagucuacacaggccgccaucgaccagaucaacgggaaacugaacagacuuauuggaaagaccaaugagaaauuccaucagaucgaaaaggaguuuagcgaagucgagggccgcauucaagaucuggaaaaguauguggaggacacgaaaaucgaucucugguccuacaacgcugagcugcugguugcgcucgaaaaucagcacacaauugaccugaccgauagcgagaugaacaaacuuuucgaaaagaccaagaaacagcugcgggagaaugccgaagacauggggaacggaugcuuuaagaucuaucauaagugugauaaugcuugcauuggcucuaucagaaacgggacauacgaccacgauguguaucgcgacgaggcccucaauaaccgguuccagaucaaaggcgucgagcugaaguccggauacaaagacuggauucuuuggaucagcuuugccauuucuugcuuccugcucuguguggcucugcugggcuuuaucaugugggccugccaaaaggggaauauuagauguaacaucugcaucuga

SEQ ID NO: 191381 - RNA, 1701 nt, Artificial Sequence; identical to SEQ ID NO: 189879
  derived and/or modified sequence opt5 from hemagglutinin__InfluenzaA__AFD98194

SEQ ID NO: 191382 - RNA, 1701 nt, Artificial Sequence; identical to SEQ ID NO: 189933
  derived and/or modified sequence opt5 from hemagglutinin__InfluenzaA__AFD98205

SEQ ID NO: 191383 - RNA, 1701 nt, Artificial Sequence; identical to SEQ ID NO: 191375
  derived and/or modified sequence opt5 from hemagglutinin__InfluenzaA__AFD98215

SEQ ID NO: 191384 - RNA, 1701 nt, Artificial Sequence; identical to SEQ ID NO: 190006
  derived and/or modified sequence opt5 from hemagglutinin__InfluenzaA__AFD98226

SEQ ID NO: 191385 - RNA, 1701 nt, Artificial Sequence
  derived and/or modified sequence opt5 from hemagglutinin__InfluenzaA__AFD98237
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcaauagcccgcaccagauccuugacggggaaaacuguacccugauugaugcccuccugggagacccccagugcgauggcuuccaaaauaaaaagugggaccuguuugucgagagauccaaagcccauucuaacuguuauccuuacgaugugcccgacuaugcuagccuccggucccugguugccagcucugggacgcuugaguucaauaacgaauccuuuaauuggaccggagugacacagaacggcaccagcucugcuugcauccgcagauccaauaacagcuucuuuucucggcugaauuggcucacacaccugaacuucaaguacccugcccuuaacgucaccaugcccaauaacgagcaguuugauaagcuguauauuuggggcgugcaucacccugggacggacaaagaucagaucuuccucuacgcgcaagccuccggacgcauuacaguuagcaccaagagaucccagcaggcugugaucccgaauauuggcucucggccccgcgucagaaacaucccuagccggguguccaucuauuggacaauugugaaacccggggacauccugcugauuaauagcaccggaaaccucaucgccccucgcggcuacuuuaagauuagaucugggaaauccagcaucaugcggucugaugcucccaucggaaaguguaauagcgccugcauuaccccgaacggcuccaucccuaaugacaagcccuuccagaacgucaaucgcauuacauacggcgcguguccuagauauguuaaacaaaacacgcugaaacuugccaccgggaugcggaaugugcccgaaaaacagacacgcggaaucuuuggcgcuauugccggguucaucgagaacggaugggaaggcaugguggacgggugguacggauuuagacaccagaauagcgagggccggggccaagcugccgaucugaagucuacccaggccgcuaucgaccagauuaacgggaaacucaacagacugaucggaaagacaaaugagaaauuccaucagauugaaaaggaguucuccgaagucgagggccgcauccaagaucuugaaaaguauguggaggacaccaaaauugaucuguggagcuacaacgcggagcuccugguugcccuggaaaaucagcacacgaucgaccucacagauucugagaugaacaagcuguuugaaaagaccaagaaacagcuucgggagaaugcugaagacauggggaacggaugcuucaagauuuaucauaagugugauaaugccugcaucggcuccaucagaaacgggaccuacgaccacgauguguaucgcgacgaggcccugaauaaccgguuucagauuaaaggcgucgagcucaagagcggauacaaagacuggauccuguggauuucuuucgcuaucuccugcuuucuucuguguguggcccuccugggcuucauuaugugggcgugccaaaaggggaauaucagauguaacaucugcauuuga

SEQ ID NO: 191386 - RNA, 1701 nt, Artificial Sequence; identical to SEQ ID NO: 191378
  derived and/or modified sequence opt5 from hemagglutinin__InfluenzaA__AFD98248

SEQ ID NO: 191387 - RNA, 1701 nt, Artificial Sequence
  derived and/or modified sequence opt5 from hemagglutinin__InfluenzaA__AFD98259
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagcaaggcuuauuccaauuguuacccuuaugacgugcaagauuacgccucucuccggagccugguugcuuccagcgggacccuugaauuuaacaaugagucuuucaacuggacgggagugacccagaauggcacauccagcgccugcauccgcagaucuaacaauuccuuuuucagccggcugaacuggcucacccaccugaauuuuaaguaucccgcgcuuaacgucacaaugccuaacaaugagcaguucgacaagcuguacauuuggggcgugcaucaccccgggaccgauaaagaccagaucuuucucuaugcccaggcuucuggacgcauuacgguuuccacaaagagaagccagcaggccgugaucccuaacauuggcucccggccgcgcgucagaaauauccccucucggaucagcauuuacuggaccaucgugaaaccuggggauauucugcugaucaacuccacaggaaaucucauugcuccccgcggcuacuucaagaucagaagcgggaaaucuuccaucaugcggagcgacgccccuauuggaaaguguaacucugaaugcaucacccccaauggcagcauuccgaacgacaagccuuuucagaaugugaaccgcaucaccuauggcgcgugucccagauacgucaaacaauccacacugaaacuugccacggggaugcggaauguuccugagaaacagacccgcggaauuuucggcgcuaucgccggguuuaucgaaaacggaugggagggcaugauggaugggugguauggauucagacaccaaaauucugagggccggggccaagcugccgaccucaagagcacacaggccgcuauugaucagaucaacgggaaacugaauagacugauuggaaagaccaacgaaaaauuccaucagaucgagaaggaauuuuccgagguggaaggccgcauucaagaccuugagaaguacguggaggauacaaaaaucgaccuguggagcuauaacgcggaacuccuggucgcccuggagaaucagcacaccauugaucucacggacucugaaaugaacaagcuguucgagaaaacaaagaaacagcuucgggaaaaugcugaggauauggggaacggaugcuuuaagaucuaccauaagugugacaaugccugcaucggcuccauuagaaacgggaccuaugaucacgacguguaccgcgacgaggcccugaauaaccgguuccagaucaaaggcguugaacucaagagcggauacaaagauuggauucuguggaucucuuuugcuauuuccugcuuccuucuguguguggcccuccugggcuuuaucaugugggcgugccaaaaggggaauaucagauguaacauuugcaucuga

SEQ ID NO: 191388 - RNA, 1701 nt, Artificial Sequence
  derived and/or modified sequence opt5 from hemagglutinin__InfluenzaA__AFD98270
augaaggccauccuggugguccuccuguacaccuucguuacagcuaacgccgacacgcuuugcauuggcuaucacgcgaauaacagcaccgauacaguggacaccgugcuggagaagaaugucacagugacccauuccguuaaccuccuggaagauaagcacaaugggaaacuuuguaagcugagaggagugacaccccuccaucugggcaaaugcaacaucgcuggguggauucugggaaauccugagugugaaucucucagcaccgccuccucuuggagcuacaucgucgagacguccucuagcgacaacgggaccugcuauccgggcgauuuuauuaauuacgaagaacugcgggagcagcuuuccagcgugucuuccuucgaacgcuuugagaucuuccccaacacaagcucuuggccuaaucacgacuccaacaagggaguuaccgccgcuuguccccaugccggcgcuaagagcuuuuauaaaaaucugaucuggcucgugaagaaaggcaacucuuacccuaagcuguccaaaagcuauauuaaugauaaggggaaggaaguccuugugcuguggggaauccaccaccccuccacaaccgccgaccaacagucucucuaccagaacgcggaugccuacguguucgucggcacgagcagauauuccaaaaaguuuaaaccugagauugcuauccggccgaagguucgcgaccaggaggggagaaugaacuacuauuggacacugguggaacccggagauaaaauuaccuucgaggccacaggcaaucugguggucccucgguacgcuuuugccauggaacgcaacgcggggagcggaaucauuaucucugacacccccgugcaugauugcaauaccacaugucaaacgccuaagggcgccaucaacaccucccuccccuuccagaauauucacccgaucacaauuggcaaaugcccuaaguauguuaagagcaccaaacugagacuugcuacagggcugcggaacgugcccucuauccagagccgcggacucuuuggcgccauugcuggguucaucgagggaggcuggaccgggauggucgacggaugguacggcuaucaucaccagaaugaacaaggcuccggguacgccgccgaccugaagucuacgcagaacgcuaucgauaaaauuacaaauaaggugaacagcguuaucgagaaaaugaauacccaguuuaccgcggugggaaaggaguucaaccaccuugaaaagagaauugagaaucugaacaaaaaggucgacgauggcuuccucgacaucuggacauacaaugccgaacugcuggugcuccuggagaacgaacggacccuugauuaucaugacuccaacgucaaaaaucuguacgagaaggugcgcaaccagcucaaaaauaacgcuaaggagauugggaauggauguuuugaguucuaucacaagugcgauaacacauguauggagagcguuaaaaauggcacguacgacuauccuaaguacucugaagaggccaaacugaacagagaagagaucgauggggugaaacuugaguccacccggaucuaucaaauucuggccaucuacagcacagucgcuucuucccucgugcugguugugagccugggcgccauuuccuuuuggaugugcucuaauggaagccuccagugccgcaucuguauuuga

SEQ ID NO: 191389 - RNA, 1701 nt, Artificial Sequence
  derived and/or modified sequence opt5 from hemagglutinin__InfluenzaA__AFD98280
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugacucucucagcacagcccgguccuggucuuacaucguggaaaccagcuccucugauaacggcacgugcuauccgggggacuuuauugauuacgaggaacugcgcgagcagcuuagcuccgucagcucuuucgagagauuugaaaucuuccccaagaccuccagcuggccuaaucacgacucuaacaagggagugacagccgcuuguccccaugccggcgcgaaaggcuuuuauaagaaucugaucuggcucguuaaaaaggggaacuccuacccuaaacugagcaagucuuauauuaaugauaagggaaaagaggugcuuguccuguggggcauccaccaccccuccaccacagccgaccaacagagccucuaccagaacgcugauaccuacguguucguggggacgucccgguauucuaagaaauuuaagccugaaauugccauccgcccgaaagucagagaccaggagggacggaugaauuacuauuggacacugguugagcccggcgauaagauuaccuucgaagcuacagggaaccugguggugccucgcuacgccuuugcgauggagagaaacgccggaagcggcaucauuaucuccgacacccccguccaugacugcaauaccacaugucaaacgccuaaaggcgcuaucaacaccagccuccccuuccagaauauucacccgaucacaauugggaagugcccuaaguaugugaaaucuaccaagcugcggcuugccacaggacugcgcaacguucccuccauccagagcagaggccucuuuggggcuauugccggauucaucgaaggcggguggaccggaaugguggauggcugguacggcuaucaucaccagaaugagcaagggucuggauacgccgcugaccugaaaagcacgcagaacgcgaucgauaagauuacaaauaaagucaacuccgugaucgaaaagaugaauacccaguuuaccgccguuggcaaggaguucaaccaccuugagaaacggauugaaaaucugaacaagaaaguggacgauggguuccucgacaucuggacauacaaugcugagcugcugguccuccuggaaaacgagcgcacccuugauuaucaugacucuaaugugaagaaccuguacgaaaaagucagaaaccagcucaagaauaacgccaaggagauuggaaauggcuguuuugaguucuaucacaaaugcgauaacacauguauggaaagcgugaagaaugggacguacgacuauccuaaauacuccgaggaagccaagcugaaccgggaggaaaucgauggcguuaaacuugagagcacccgcaucuaucaaauucuggcuaucuacucuacaguggccuccagccucguccuggugguuucucugggagcgauuuccuuuuggaugugcagcaauggcucccuccagugcagaaucuguauuuga

SEQ ID NO: 191390 - RNA, 1701 nt, Artificial Sequence; identical to SEQ ID NO: 191367
  derived and/or modified sequence opt5 from hemagglutinin__InfluenzaA__AFD98290

SEQ ID NO: 191391 - RNA, 1701 nt, Artificial Sequence; identical to SEQ ID NO: 190110
  derived and/or modified sequence opt5 from hemagglutinin__InfluenzaA__AFD98310

SEQ ID NO: 191392 - RNA, 1701 nt, Artificial Sequence; identical to SEQ ID NO: 189478
  derived and/or modified sequence opt5 from hemagglutinin__InfluenzaA__AFD98320

SEQ ID NO: 191393 - RNA, 1701 nt, Artificial Sequence; identical to SEQ ID NO: 191378
  derived and/or modified sequence opt5 from hemagglutinin__InfluenzaA__AFD98340

SEQ ID NO: 191394 - RNA, 1701 nt, Artificial Sequence
  derived and/or modified sequence opt5 from hemagglutinin__InfluenzaA__AFD98351
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgcccuggagaaucaacacaccauugaucucacggacucugaaaugaacaaacuguucgagaagaccaaaaagcagcuuagagaaaaugcugaggauauggggaacggaugcuuuaaaaucuaccauaagugugacaaugccugcaucggcacaauucgcaacgggaccuaugaucacgacguguaccgggacgaggcccugaauaacagauuccagaucaagggcguugaacucaaauccggauacaaggauuggauucuguggaucagcuuugcuauuucuugcuuccuucuguguguggcccuccugggcuuuaucaugugggcgugccagaaagggaauauccgcuguaacauuugcaucuga

SEQ ID NO: 191395 - RNA, 1701 nt, Artificial Sequence
  derived and/or modified sequence opt5 from hemagglutinin__InfluenzaA__AFD98362
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcaaaauucuagcaccggcgagaucugcgacuccccgcaccagauccuugauggggaaaacuguacacugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauccgcagaagcaauaacuccuuuuucucucggcugaauuggcucacccaucugaacuuuaaguauccugcccuuaacgucacaaugcccaauaacgagcaguucgacaagcuguacauuuggggcgugcaccauccugggaccgauaaagaccagaucuuucucuaugcgcaagccagcggacgcauuacgguuucuacaaagagaggccagcaggcugugaucccgaauauugggucccggccccgcgucagaaacaucccuagccggaucuccauuuacuggaccaucgugaaacccggagauauucugcugaucaauucuacaggcaaccucauugccccucgcggguacuucaagaucagaagcggaaaauccagcaucaugcggucugacgcucccauuggcaaguguaauuccgaaugcaucaccccgaacggcagcauuccuaaugacaagcccuuucagaacgugaaucgcaucaccuauggggccuguccuagauacgucaaacaaaacacacugaagcuggcgacgggaaugcggaauguucccgagaaacagacccgcggcauuuucggggccaucgcuggauuuaucgaaaacggcugggaggggaugguggauggaugguauggcuucagacaccaaaauucugagggccgggggcaggccgcugaccuuaagagcacacaggccgccauugaucagaucaacggaaaacucaacagacuggugggcaagaccaaugaaaaauuccaccagauugagaaggaauuuuccgaggucgaagggcgcauccaagaccuugagaaguacguggaggauacaaaaauugaccuguggucuuauaacgcugaacuccugguugcgcuggagaaucagcauaccaucgaucucacggacagcgaaaugaacaagcuguucgagaaaacaaagaaacagcuucgggaaaaugccgaggauaugggaaacggcugcuuuaagauuuaccacaagugugacaaugcuugcaucggguccaucagaaacggcaccuaugaucaugacguguaccgcgacgaggcccugaauaaccgguuccagauuaaaggagucgaacucaagagcggcuacaaagauuggauccuguggauuucuuuugccaucuccugcuuccuucuguguguggcucuccugggguuuauuaugugggccugccaaaagggaaauaucagauguaacaucugcauuuga

SEQ ID NO: 191396 - RNA, 1701 nt, Artificial Sequence; identical to SEQ ID NO: 191375
  derived and/or modified sequence opt5 from hemagglutinin__InfluenzaA__AFD98373

SEQ ID NO: 191397 - RNA, 1701 nt, Artificial Sequence; identical to SEQ ID NO: 190006
  derived and/or modified sequence opt5 from hemagglutinin__InfluenzaA__AFD98384

SEQ ID NO: 191398 - RNA, 1701 nt, Artificial Sequence
  derived and/or modified sequence opt5 from hemagglutinin__InfluenzaA__AFD98395
augaagaccaucauugcccugagcuacauccucugccugguguucgcucagaaacuucccggcgacgauaacuccacagccacgcugugucucgggcaccaugcggucccuaauggaaccauuguuaagacaaucaccaacgaccaaauugaggugacaaaugcuaccgaacuggugcagaacucuagcgccggcgagaucugcgauuccccgcaccauauccuugacggggaaaauuguacacugauugaugcccuccugggagacccccagugcgauggcuuucagaacaaaaagugggaccuguucgucgagagaucucgggcuuauagcaauuguuacccuuaugaugugcccgacuacgccucccuccgcucucugguugcuagcuccgggacccuugaauuuaacaaugagagcuucaacuggacgggagugacccaaaauggcacaucuuccgccugcaucagacggagcaacaauuccuuuuucucucgccugaacuggcucacccaccugaauuuuaaauauccugcgcuuaacgucacaaugcccaacaaugagcaguucgauaagcuguacauuuggggcgugcaucacccugggaccgacaaggaucagaucuuucucuaugcccaggcuagcggaagaauuacgguuucuacaaaacggucccaacaggccgugaucccgaacauuggcagccgccccagaguccggaauaucccuucccgcaucucuauuuacuggaccaucgugaagcccggggacauucugcugaucaacagcacaggaaaucucauugcuccuagaggcuacuucaaaauccgguccgggaaaagcucuaucaugcgcuccgacgcccccauuggaaaauguaacagcgaaugcaucaccccgaauggcucuauuccuaacgauaagcccuuucagaaugugaacagaaucaccuauggcgcguguccucgguacgucaagcagagcacacugaaacuugccacggggaugcgcaauguucccgagaagcaaaccagaggaauuuucggcgcuaucgccggguuuaucgaaaacggaugggagggcaugauggacgggugguauggauuccggcaccaaaauuccgagggcagaggccaggcugccgaucugaaaucuacacaggccgcuauugaccagaucaacgggaagcucaaucgccugauuggaaaaaccaacgaaaaguuccaucagaucgagaaagaauuuagcgagguggaaggccggauucaggaucuugagaaguacguggaggacacaaagaucgaucugugguccuauaacgcggaacuccuggucgcccuggagaaucaacacaccauugaccucacggauagcgaaaugaacaaacuguucgagaagacaaagaagcagcuuagagaaaaugcugaggacauggggaacggaugcuuuaaaaucuaccauaagugugauaaugccugcaucggcucuauucgcaacgggaccuaugaccacgacguguaccgggaugaggcccugaauaacagauuccagaucaagggcguugaacucaaauccggauacaaggacuggauucuguggaucagcuuugcuauuucuugcuuccuucuguguguggcccuccugggcuuuaucaugugggcgugccagaaagggaauauccgcuguaacauuugcaucuga

SEQ ID NO: 191399 - RNA, 1701 nt, Artificial Sequence; identical to SEQ ID NO: 191375
  derived and/or modified sequence opt5 from hemagglutinin__InfluenzaA__AFD98406

SEQ ID NO: 191400 - RNA, 1701 nt, Artificial Sequence; identical to SEQ ID NO: 191378
  derived and/or modified sequence opt5 from hemagglutinin__InfluenzaA__AFD98417

SEQ ID NO: 191401 - RNA, 1701 nt, Artificial Sequence
  derived and/or modified sequence opt5 from hemagglutinin__InfluenzaA__AFD98428
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucauaagugugauaaugccugcauuggcucuaucagaaacgggacauacgaccacgauguguaucgcgacgaggcccugaauaaccgguuccagaucaaaggcgucgagcucaaguccggauacaaagacuggauucuguggaucagcuuuaccauuucuugcuuccuucuguguguggcucuccugggcuuuaucaugugggccugccaaaaggggaauauuagauguaacaucugcaucuga

SEQ ID NO: 191402 - RNA, 1701 nt, Artificial Sequence; identical to SEQ ID NO: 189891
  derived and/or modified sequence opt5 from hemagglutinin__InfluenzaA__AFD98439

SEQ ID NO: 191403 - RNA, 1701 nt, Artificial Sequence
  derived and/or modified sequence opt5 from hemagglutinin__InfluenzaA__AFD98449
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaaacuucaauuggaccggagugacacagaacggcaccucuuccgcuugcauccgcagaagcaagaauagcuuuuucucccggcugaacuggcucacacaucugaauuuuaaauucccugcccuuaacgucaccaugcccaacaaugagcaguuugacaagcuguauauuuggggcgugcaccauccugggacggauaaagaccagaucuuccucuacgcgcaagccagcggacgcauuacaguuucuaccaagagaucccagcagacagcuaucccgaacauuggcagccggccccgcgugagaaauaucccuucccggaucucuauuuauuggaccaucgucaaacccggggauauucugcugaucaacagcaccggaaaucucauugccccucgcggcuacuuuaagaucagauccgggaagucuucuaucaugcgguccgacgcucccauuggaaaauguaacagcgagugcaucacaccgaauggcucuauuccuaacgacaagcccuuccagaaugugaaccgcaucacguacggcgccuguccuagauaugugaaacaaaauacccugaaacuugcgacagggaugcggaacguccccgaaaaacagacccgcggaauuuuuggcgccaucgcuggguucaucgagaauggaugggaaggcaugguugaugggugguacggauucagacaccagaacagcgagggccggggccaagccgcugaccugaaguccacacaggccgccauugaucagaucaaugggaaacucaacagacugauuggaaagaccaacgagaaguuucaccagaucgaaaaagaguucucugaaguggagggccgcauucaagaccuugaaaaguauguggaggauacgaaaaucgaccuguggagcuacaaugcugagcuccuggucgcgcuggaaaaccagcauacaauugaucucaccgacuccgagaugaauaagcuguuugaaaagaccaagaagcagcuucgggagaacgccgaagauauggggaauggaugcuucaaaaucuaucacaagugugacaacgcuugcaucggcagcauuagaaaugggacauacaaccaugauguguaucgcgacgaggcccugaauaaccgguuucagaucaaaggcguugagcucaagucuggauacaaagacuggauucuguggaucuccuucgccauuagcugcuuucuucuguguguggcucuccugggcuucaucaugugggccugccaaaaggggaauaucagauguaacauuugcaucuga

SEQ ID NO: 191404 - RNA, 1701 nt, Artificial Sequence
  derived and/or modified sequence opt5 from hemagglutinin__InfluenzaA__AFD98460
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagcaaacugaacuggcucacccaccugaauuuuaaguauccugcgcuuaacgucacaaugcccaacaaugagcaguucgacaagcuguacauuuggggcgugcaucacccugggaccgauaaagaccagaucuuucucuaugcccaggcuucuggacgcauuacgguuuccacaaagagaagccaacaggccgugaucccgaacauuggcucccggccccgcgucagaaauaucccuucucggaucagcauuuacuggaccaucgugaaacccggggauauucugcugaucaacuccacaggaaaucucauugcuccucgcggcuacuucaagaucagaagcgggaaaucuuccaucaugcggagcgacgcccccauuggaaaguguaacucugaaugcaucaccccgaauggcagcauuccuaacgacaagcccuuucagaaugugaaccgcaucaccuauggcgcguguccuagauacgucaaacaguccacacugaagcuggccacggggaugcggaauguucccgagaaacaaacccgcggaauuuucggcgcuaucgccggguuuaucgaaaacggaugggagggcaugauggaugggugguauggauucagacaccaaaauucugagggccggggccaggcugccgaccuuaagagcacacaggccgcuauugaucagaucaacgggaaacucaauagacugauuggaaagaccaacgaaaaauuccaucagaucgagaaggaauuuuccgagguggaaggccgcauucaggaccuugagaaguacguggaggauacaaaaaucgaccuguggagcuauaacgcggaacuccuggucgcccuggagaaucaacacaccauugaucucacggacucugaaaugaacaagcuguucgagaaaacaaagaaacagcuucgggaaaaugcugaggauauggggaacggaugcuuuaagaucuaccauaagugugacaaugccugcaucggcuccauuagaaacgggaccuaugaucacgacguguaccgcgacgaggcccugagcaaucgguuccagaucaaaggcguugaacucaagucuggauacaaagauuggauucuguggaucuccuuugcuauuagcugcuuccuucuguguguggcccuccugggcuuuaucaugugggcgugccagaaggggaacaucagauguaauauuugcaucuga

SEQ ID NO: 191405 - RNA, 1701 nt, Artificial Sequence; identical to SEQ ID NO: 189891
  derived and/or modified sequence opt5 from hemagglutinin__InfluenzaA__AFD98471

SEQ ID NO: 191406 - RNA, 1701 nt, Artificial Sequence
  derived and/or modified sequence opt5 from hemagglutinin__InfluenzaA__AFD98481
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcaacuccccgcaccagauccuugacggggaaaauuguacccugauugaugcccuccugggagacccccagugcgauggcuuucagaacaaaaagugggaccuguucgucgagagaucuaaagcccauagcaauuguuauccuuacgaugugcccgacuaugcuucccuccggucucugguugccagcuccgggacgcuugaauuuaacaaugagagcuucaacuggaccggagugacacagaauggcaccucuuccgcuugcauccgcagaagcaacaauagcuuuuucucccggcugaacuggcucacacaccugaacuuuaaguacccugcccuuaaugucaccaugcccaacaaugagcaguucgauaagcuguauauuuggggcgugcaucacccugggacggacaaagaucagaucuuucucuacgcgcaagccgcuggacgcauuacaguuagcaccaagagaucucagcaggccgugaucccgaacauuggcucccggccccgcgucagaaauaucccuagccggguguccaucuauuggacaauugugaaacccggggacauccugcugauuaacucuaccggaaaucucaucgcuccucgcggcuacuucaagauuagaagcgggaaauccagcgucaugcggucugaugcccccaucggaaaguguaacuccgcgugcaucaccccgaauggcagcauuccuaacgacaagcccuuucagaauguuaaccgcaucacauacggcgccuguccuagauaugugaaacaaaauacgcugaaacuugcuaccgggaugcggaacgugcccgaaaaacagacacgcggaauuuucggcgccaucgcuggguuuauugagaauggaugggaaggcauggucgacgggugguacggauucagacaccagaacucugagggccggggccaagccgccgaucugaagucuacccaggcugcgaucgaccagaucaacgggaaacucaauagacugauuggaaagacaaacgagaaauuccaucagaucgaaaaggaguuuuccgaaguggagggccgcauucaagaucuugaaaaguauguugaggacaccaaaaucgaucuguggucuuacaaugccgagcuccugguggcucuggaaaaccagcacacgauugaccucacagauagcgagaugaauaagcuguucgaaaagaccaagaaacagcuucgggagaacgccgaagacauggggaauggaugcuuuaagaucuaucauaagugugauaacgccugcauuggcuccaucagaaaugggaccuacgaccacgaugucuaucgcgacgaggcucugaacaaucgguuccagaucaaaggcguggagcucaagagcggauacaaagacuggauucuguggaucucuuuugccauuuccugcuuccuucuguguguugcgcuccugggcuuuaucaugugggcuugccaaaaggggaacauuagauguaauaucugcaucuga

SEQ ID NO: 191407 - RNA, 1701 nt, Artificial Sequence; identical to SEQ ID NO: 190006
  derived and/or modified sequence opt5 from hemagglutinin__InfluenzaA__AFD98492

SEQ ID NO: 191408 - RNA, 1701 nt, Artificial Sequence
  derived and/or modified sequence opt5 from hemagglutinin__InfluenzaA__AFD98503
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccaaaggaauuuucggcgcuaucgccggguuuaucgaaaacggaugggagggcaugauggaugggugguauggauucagacaccagaauagcgagggccggggccaggcugccgaccugaagucuacacaagccgcuauugaucagaucaacgggaaacucaauagacugauuggaaagaccaacgaaaaauuccaucagaucgagaaggaauuuuccgagguggaaggccgcauucaggaccuugagaaguacguggaggauacaaaaaucgaccuguggagcuauaacgcggaacuccuggucgcccuggagaaucaacacaccauugaucucacggacucugaaaugaacaagcuguucgagaaaacaaagaaacagcuucgggaaaaugcugaggauauggggaacggaugcuuuaagaucuaccauaagugugacaaugccugcaucggcuccauuagaaacgggaccuaugaucacgacguguaccgcgacgaggcccugaauaaccgguuccagaucaaaggcguugaacucaagagcggauacaaagauuggauucuguggaucucuuuugcuauuuccugcuuccuucuguguguggcccuccugggcuuuaucaugugggcgugccagaaggggaauaucagauguaacauuugcaucuga

SEQ ID NO: 191409 - RNA, 1701 nt, Artificial Sequence; identical to SEQ ID NO: 190006
  derived and/or modified sequence opt5 from hemagglutinin__InfluenzaA__AFD98514

SEQ ID NO: 191410 - RNA, 1701 nt, Artificial Sequence; identical to SEQ ID NO: 191358
  derived and/or modified sequence opt5 from hemagglutinin__InfluenzaA__AFD98525

SEQ ID NO: 191411 - RNA, 1701 nt, Artificial Sequence; identical to SEQ ID NO: 189879
  derived and/or modified sequence opt5 from hemagglutinin__InfluenzaA__AFD98558

SEQ ID NO: 191412 - RNA, 1701 nt, Artificial Sequence
  derived and/or modified sequence opt5 from hemagglutinin__InfluenzaA__AFD98569
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagacauuucucuacgcgcaagccucuggacgcaucaccguuuccacaaagagaagccagcaggcugugauuccgaauaucggcucccggccccgcgucagaaacauuccuucucgggugagcaucuauuggaccaucgugaaacccggggacauucugcugaucaauuccaccggaaaccucauugccccucgcggcuacuucaagaucagaagcgggaaaucuuccauuaugcggagcgaugcucccaucggaaaguguaauucugccugcaucacaccgaacggcagcauuccuaaugacaagcccuuucagaacgucaaucgcaucacguacggcgcguguccuagauauguuaaacaaaacacccugaaacuugccacagggaugcggaaugugcccgaaaaacagacccgcggaauuuucggcgcuaucgccggguuuauugagaacggaugggaaggcaugguggacgggugguacggauucagacaccaaaauuccgagggccggggccaggcugccgaucugaagucuacacaggccgcuaucgaccagaucaacgggaaacucaacagacugauuggaaagaccaaugagaaauuccaucagaucgaaaaggaguuuagcgaagucgagggccgcauucaagaucuugaaaaguauguggaggacacgaaaaucgaucugugguccuacaacgcggagcuccugguugcccuggaaaaucagcacacaauugaccucaccgauagcgagaugaacaagcuguucgaaaagaccaagaaacagcuucgggagaaugcugaagacauggggaacggaugcuuuaagaucuaucaugagugugauaaugccugcauuggcucuaucagaaacgggacauacgaccacgauguguaucgcgacgaggcccugaauaaccgguuccagaucaagggcgucgaacucaaauccggauacaaggacuggauucuguggaucagcuuugcuauuucuugcuuccuucuguguguggcccuccugggcuuuaucaugugggcgugccaaaaagggaauauuagauguaacaucugcaucuga

SEQ ID NO: 191413 - RNA, 1701 nt, Artificial Sequence; identical to SEQ ID NO: 189879
  derived and/or modified sequence opt5 from hemagglutinin__InfluenzaA__AFD98580

SEQ ID NO: 191414 - RNA, 1701 nt, Artificial Sequence
  derived and/or modified sequence opt5 from hemagglutinin__InfluenzaA__AFE02942
augaaggccauccuggugguccuccuguacaccuucgcuacagccaacgcggacacgcuuugcauuggcuaucacgcuaauaacagcaccgauacaguugacacccugcucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccaacucugacaauggcacgugcuauccgggggauuuuauugacuacgaagaacuucgggagcagcugagcuccgugagcucuuucgaacgcuuugagaucuuccccaagaccuccagcuggccuaaccacgauucuaauaagggagucacagccgcuuguccccaugccggcgcgaaauccuuuuauaagaaccucaucuggcuggugaaaaagggcaauagcuacccuaaacuuucuaaguccuauauuaacgacaaggggaaagaaguucuggugcucuggggaauccaccaccccagcaccuccgccgaucaacagucucuguaccagaaugcugacgccuacgucuucguguggacaagcagauauuccaagaaauuuaagccugagauugcuauccggccgaaagugcgcgaucaggagggcagaaugaacuacuauuggacccuggucgaacccggggacaagauuacguucgaggccacaggaaaccucguugugccucgguacgcguuugccauggaucgcaaugcuggcagcgggaucauuaucucugacacccccgugcaugacugcaacacaaccugucaaaccccuaaaggagccaucaauacaucccugcccuuccagaacauucacccgaucacgauuggcaagugcccuaaguaugucaaaagcaccaaacuuagacuggcuacaggccuccggaaugugcccucuauccagagccgcgggcuguuuggagccauugccggcuucaucgaagggggauggaccggcaugguugaugggugguacggauaucaucaccagaacgagcaaggcuccggcuacgcugcggaccuuaagucuacacagaaugccaucgaugaaauuaccaacaaggugaauagcgucaucgagaaaaugaacacgcaguuuacagcuguggggaaggaguucaaucaccuggaaaagagaauugagaaccucaauaaaaagguugacgauggauuccuggacaucuggaccuacaacgccgaacugcucgugcugcuugagaaugaacggacccuggauuaucaugacuccaacgucaaaaaccucuacgagaaggugcgcagccagcugaaaaauaacgccaaggagauuggcaauggguguuuugaguucuaucacaagugcgauaacacauguauggagucugucaaaaauggaaccuacgacuauccuaaguacuccgaagaggcuaaacuuaacagagaagagaucgauggcgugaagcuggagagcacacggaucuaucaaauucucgccaucuacucuacgguugcguccagccuggugcuggucgugucccucggggcuauuucuuuuuggaugugcagcaauggcucccugcagugccgcaucuguauuuga

SEQ ID NO: 191415 - RNA, 1701 nt, Artificial Sequence; identical to SEQ ID NO: 186857
  derived and/or modified sequence opt5 from hemagglutinin__InfluenzaA__AFE18688

SEQ ID NO: 191416 - RNA, 1701 nt, Artificial Sequence; identical to SEQ ID NO: 183674
  derived and/or modified sequence opt5 from hemagglutinin__InfluenzaA__AFE47624

SEQ ID NO: 191417 - RNA, 1701 nt, Artificial Sequence; identical to SEQ ID NO: 184424
  derived and/or modified sequence opt5 from hemagglutinin__InfluenzaA__AFE47635

SEQ ID NO: 191418 - RNA, 1701 nt, Artificial Sequence; identical to SEQ ID NO: 190006
  derived and/or modified sequence opt5 from hemagglutinin__InfluenzaA__AFF18506

SEQ ID NO: 191419 - RNA, 1701 nt, Artificial Sequence
  derived and/or modified sequence opt5 from hemagglutinin__InfluenzaA__AFF57124
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaaggaaaauagcuacccuaaacuguccaagagcuauauuaacgauaagggcaaagaggugcuuguccugugggggauccaccaccccuccaccacagccgaccaacagagacucuaccagaaugcugaugccuacguguucgugggaaccucucgguauagcaagaaauuuaagccugagauugcuauccgcccgaaagucagagaccaggaaggccggaugaacuacuauuggacgcugguugagcccggggauaagauuacauucgaagccaccggaaaccugguggugccucgcuacgcguuugccauggagagaaaugcuggcuccgggaucauuaucagcgacacacccguccaugauugcaacaccaccugucaaacaccuaaaggagccaucaauacgucucuccccuuccagaacauucacccgaucaccauuggcaagugcccuaaguaugugaaauccacaaagcugcggcuugcuaccggccugcgcaauguucccagcauccagucuagagggcucuuuggagccauugccggcuucaucgaagggggauggacaggcaugguggacgggugguacggauaucaucaccagaacgagcaaggcagcggcuacgcugcggaccugaaauccacccagaaugccaucgauaagauuacgaacaaagucaauucugugaucgagaagaugaacacacaguuuaccgcuguugggaaggaguucaaucaccuugagaaacggauugaaaaccugaauaagaaaguggacgauggauuccucgacaucuggaccuacaacgccgagcugcugguccuccuggaaaaugagcgcacacuugauuaucaugacagcaacgugaagaaccuguacgagaaagucagaaaucagcucaagaacaaugccaaggaaauuggcaacggguguuuugaguucuaucacaaaugcgauaauaccuguauggaauccgugaagaacggaacauacgacuauccuaaauacagcgaggaagcuaagcugaaucgggaggagaucgauggcguuaaacuugaaucuacgcgcaucuaucaaauucuggccaucuacuccaccguggcgagcucucucguccuggugguuucccugggggcuauuagcuuuuggaugugcuccaacggcucucuccagugcagaaucuguauuuga

SEQ ID NO: 191420 - RNA, 1701 nt, Artificial Sequence
  derived and/or modified sequence opt5 from hemagglutinin__InfluenzaA__AFF57128
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucuauuuaccagaaugcugaugccuacguguucgugggcaccagcagauauuccaagaaauuuaagccugagaucgcuauucggccgaaaguccgcgaccaggaggggagaaugaacuacuauuggacgcucguugaacccggagauaagaucacauucgaggccaccggcaaccugguggugccucgguacgcguuugccauggaacgcaaugcugggagcggaauuaucaucucugacacacccguccaugauugcaacaccaccugucaaacaccuaaaggcgccauuaauacgucccugcccuuccagaacauccacccgauuaccaucggcaagugcccuaaguaugugaaaagcacaaagcucagacuggcuaccgggcuucggaauguucccucuauucagagccgcggacuguuuggcgccaucgccggguucaucgagggaggcuggacagggaugguggacggaugguacggcuaucaucaccagaacgaacaaggcuccggguacgcugcggaccucaaaucuacccagaaugccauugauaagaucacgaacaaagucaauagcgugauugagaagaugaacacacaguuuaccgcuguuggaaaggaguucaaucaccuggagaaaagaaucgagaaccuuaauaagaaaguggacgauggcuuccuggacauuuggaccuacaacgccgaacuccugguccugcucgagaaugaacggacacuggauuaucaugacuccaacgugaagaaccuuuacgagaaaguccgcaaucagcugaagaacaaugccaaggagaucgggaacggauguuuugaguucuaucacaaaugcgauaauaccuguauggaaagcgugaagaacggcacauacgacuauccuaaauacucugaagaggcuaagcucaauagagaagagaucgaugggguuaaacuggaguccacgcggauuuaucaaauccuugccauuuacagcaccguggcgucuucccugguccucgugguuagccugggcgcuaucuccuuuuggaugugcucuaacggaagccugcagugccgcauuuguaucuga

SEQ ID NO: 191421 - RNA, 1701 nt, Artificial Sequence
  derived and/or modified sequence opt5 from hemagglutinin__InfluenzaA__AFF57132
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacaguccauuuaccagaacgcugacaccuacguguucguggggacgucuagauauagcaagaaauuuaagccugagaucgccauucggccgaaaguccgcgaucaggagggaagaaugaauuacuauuggacacucguugaacccggcgacaagaucaccuucgaggcuacagggaaccugguggugccucgguacgccuuugcgauggaacgcaacgccggauccggcauuaucaucagcgauacccccguccaugacugcaauaccacaugucaaacgccuaaaggcgcuauuaacaccucucugcccuuccagaauauccacccgauuacaaucgggaagugcccuaaguaugugaaauccaccaagcucagacuggccacaggacuucggaacguucccagcauucagucucgcggccuguuuggggcuaucgccggauucaucgagggcggguggaccggaaugguggacggcugguacggcuaucaucaccagaaugaacaagggagcggauacgccgcugaucucaaauccacgcagaacgcgauugacaagaucacaaauaaagucaacucugugauugagaagaugaauacccaguuuaccgccguuggcaaggaguucaaccaccuggagaaaagaaucgagaaucuuaacaagaaaguggaugacggguuccuggauauuuggacauacaaugcugaacuccugguccugcucgagaacgaacggacccuggacuaucaugauagcaaugugaagaaccuuuacgagaaaguccgcaaccagcugaagaauaacgccaaggagaucggaaauggcuguuuugaguucuaucacaaaugcgacaacacauguauggaauccgugaagaaugaaacguacgauuauccuaaauacagcgaggaagccaagcucaacagagaggagaucgacgggguuaaacuggaaucuacccggauuuaucaaauccuugcuauuuacuccacaguggccagcucucugguccucgugguuucccugggcgcgaucagcuuuuggaugugcuccaauggaucucugcagugccgcauuuguaucuga

SEQ ID NO: 191422 - RNA, 1701 nt, Artificial Sequence
  derived and/or modified sequence opt5 from hemagglutinin__InfluenzaA__AFF57136
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgauagagaggggcggaugaauuacuauuggacacugguugaacccggagacaagauuaccuucgaggccacgggcaaccugguggugccucgcuacgcguuugccauggaaagaaacgcuggguccggaaucauuaucagcgauacacccgucuaugacugcaauaccacaugucagaccccuaaaggcgccaucaacaccucucuccccuuccaaaauauucauccgaucacaauuggcaagugcccuaaguacgugaaaagcacgaagcugcggcuugcuaccgggcugcgcaacguucccuccauccagucuagaggacucuuuggcgccauugccggguucaucgagggaggcuggacagggaugguggacggaugguauggcuaccaccaucagaaugaacagggcagcggguacgcugcggaucugaaauccacccaaaacgccaucgacgagauuacaaauaaggucaacagcgugaucgagaaaaugaauacccaguuuacggcuguuggaaaggaguucaaccaccuugagaagcggauugaaaaucugaacaaaaagguggaugacggcuuccucgauaucuggacauauaaugccgagcugcugguccuccuggaaaacgagcgcacccuugacuaccacgauucuaaugugaaaaaccuguaugagaaggucagaucccagcucaaaaacaaugccaaggaaauugggaacggauguuuugaguucuaccauaagugcgacaauaccuguauggaaagcgugaaaaacggcacauaugauuacccuaaguauucugaggaagcuaaacugaaucgggaggagaucgacgggguuaaacuugaauccacccgcaucuaccagauucuggccaucuacagcacaguggcguccucucucguccuggugguuagccugggcgcuauuuccuuuuggaugugcucuaacggaagccuccaaugcagaaucuguauuuga

SEQ ID NO: 191423 - RNA, 1701 nt, Artificial Sequence
  derived and/or modified sequence opt5 from hemagglutinin__InfluenzaA__AFF57144
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugaugaccaacagagccucuaccagaacgaggaugccuacguguucgugggcuccagcagauauucuaagaaauuuaagccugagauugcuauccggccgaaaguccgcgacagagaagggcggaugaauuacuauuggacacugguugagcccggagauaagauuaccuucgaagccacgggcaaccugguggugccucgcuacgcuuuugccauggagagaaacgcgggguccggaaucauuaucagcgacacacccguccaugacugcaauaccacaugucagaccccuaaaggcgccaucaacaccucucuccccuuccaaaauauucacccgaucacaauuggcaagugcccuaaguaugugaaaagcacgaagcugcggcuugcuaccgggcugcgcaacguucccuccauccagucuagaggacucuuuggcgccauugcuggguucaucgaaggaggcuggacagggaugguggauggaugguacggcuaucaucaccagaaugagcagggcagcggguacgccgccgaccugaaauccacccaaaacgcuaucgaugagauuacaaauaaggucaacagcgugaucgaaaagaugaauacccaguuuacggcgguuggaaaggaguucaaccaccuugaaaagcggauugagaaucugaacaaaaagguggacgauggcuuccucgacaucuggacauacaaugccgaacugcugguccuccuggagaacgagcgcacccuugauuaucaugacucuaaugugaaaaaccuguacgaaaaggucagaucccagcucaaaaacaaugcuaaggagauugggaacggauguuuugaguucuaucacaagugcgauaauaccuguauggagagcgugaaaaacggcacauacgacuauccuaaguacucugaagaggccaaacugaaucgggaggaaaucgaugggguuaaacuugaguccacccgcaucuaucagauucuggccaucuacagcacaguggcuuccucucucguccuggugguuagccugggcgccauuuccuuuuggaugugcucuaacggaagccuccaaugcagaaucuguauuuga

SEQ ID NO: 191424 - RNA, 1701 nt, Artificial Sequence
  derived and/or modified sequence opt5 from hemagglutinin__InfluenzaA__AFF57148
augaaggccauccuggugguccuccuguacaccuucgcuacagccaacgcggacacgcuuugcauuggcuaucacgcuaauaacagcaccgauacaguugacacccugcucgagaaaaaugugacagugacccauuccgucaaccugcuugaagauaagcacaaugggaaacuguguaagcucagaggaguggcuccccugcaucugggcaaaugcaacaucgccggguggauucucggaaauccugagugugaaucucugagcacagccuccucuuggagcuacaucguugagaccuccucuagcgacaacggcacgugcuauccgggggauuuuauugacuacgaagaacuucgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucucaucuggcuggugaaaaagggcaacagcuacccuaaacuuuccaagagcuauauuaaugacaaggggaaagaaguucuggugcucuggggaauccaccaccccuccaccucugaugaccaacagagccuguaccagaacgaggaugccuacgucuucgugggcuccagcagauauucuaagaaauuuaagccugagauugcuauccggccgaaagugcgcgacagagaagggcggaugaauuacuauuggacacuggucgagcccggagauaagauuaccuucgaagccacgggcaaccucguugugccucgcuacgcuuuugccauggagagaaacgcgggguccggaaucauuaucagcgacacacccgugcaugacugcaauaccacaugucagaccccuaaaggcgccaucaacaccucucugcccuuccaaaauauucacccgaucacaauuggcaagugcccuaaguaugucaaaagcacgaaacuucggcuggcuaccgggcuccgcaacgugcccuccauccagucuagaggacuguuuggcgccauugcuggguucaucgaaggaggcuggacagggaugguugauggaugguacggcuaucaucaccagaaugagcagggcagcggguacgccgccgaccuuaaauccacccaaaacgcuaucgaugagauuacaaauaaggugaacagcgucaucgaaaagaugaauacccaguuuacggcggugggaaaggaguucaaccaccuggaaaagcggauugagaaucucaacaaaaagguugacgauggcuuccuggacaucuggacauacaaugccgaacugcucgugcugcuugagaacgagcgcacccuggauuaucaugacucuaaugucaaaaaccucuacgaaaaggugagaucccagcugaaaaacaaugcuaaggagauugggaacggauguuuugaguucuaucacaagugcgauaauaccuguauggagagcgucaaaaacggcacauacgacuauccuaaguacucugaagaggccaaacuuaaucgggaggaaaucgauggggugaagcuggaguccacccgcaucuaucagauucucgccaucuacagcacaguugcuuccucucuggugcuggucgugagccucggcgccauuuccuuuuggaugugcucuaacggaagccugcaaugcagaaucuguauuuga

SEQ ID NO: 191425 - RNA, 1701 nt, Artificial Sequence
  derived and/or modified sequence opt5 from hemagglutinin__InfluenzaA__AFF57160
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccgaaagcuauauuaaugacaaggggaaggaggugcuuguccuguggggaauccaccaccccuccaccucugccgaucaacagagccucuaccagaacgaggacgcuuacguguucgugggcuccagcagauauucuaaaaaguuuaaaccugaaauugccauccggccgaagguccgcgauagagaggggcggaugaauuacuauuggacacugguugaacccggagacaaaauuaccuucgaggcuacgggcaaccugguggugccucgcuacgccuuugcgauggaaagaaacgccggguccggaaucauuaucagcgauacacccguccaugacugcaauaccacaugucagaccccuaagggcgcuaucaacaccucucuccccuuccaaaauauucacccgaucacaauuggcaaaugcccuaaguauguuaagagcacgaaacugcggcuugccaccgggcugcgcaacgugcccuccauccagucuagaggacucuuuggcgcuauugccggguucaucgagggaggcuggacagggaugguggacggaugguacggcuaucaucaccagaaugagcagggcagcggguacgccgcugaucugaaguccacccaaaacgcgaucgacgaaauuacaaauaaagucaacagcgugaucgagaagaugaauacccaguuuacggccguuggaaaagaguucaaccaccuugagaagcggauugaaaaucugaacaagaaaguggaugacggcuuccucgauaucuggacauacaaugcugagcugcugguccuccuggagaacgaacgcacccuugacuaucaugauucuaaugugaagaaccuguacgagaaagucagaucccagcucaagaacaaugccaaagaaauugggaacggauguuuugaguucuaucacaagugcgacaauaccuguauggaaagcgugaagaacggcacauacgauuauccuaaauacucugaggaggccaagcugaaucgggaagagaucgacgggguuaaacuugaauccacccgcaucuaucagauucuggcuaucuacagcacaguggccuccucucucguccuggugguuagccugggcgcgauuuccuuuuggaugugcucuaacggaagccuccaaugcagaaucuguauuuga

SEQ ID NO: 191426 - RNA, 1701 nt, Artificial Sequence
  derived and/or modified sequence opt5 from hemagglutinin__InfluenzaA__AFF57164
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugagaaacuuuguaagcugagagggguugcuccccuccaucugggaaaaugcaacaucgccggcuggauucuggggaauccugaaugugagucucucagcacagccuccucuuggagcuacaucguggaaaccuccucuagcgacaacggaacgugcuauccgggcgauuuuauugacuacgaggagcugcgggaacagcuuuccagcgucucuuccuucgagcgcuuugaaaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaggugcuuguccugugggggauccaccaccccuccaccucugccgaucaacagagccucuaccagaacgcugacgccuacguguucgugggauccagcagauauucuaagaaauuuaagccugagauugcuauccggccgaaaguccgcgauagagaaggccggaugaauuacuauuggacacugguugagcccggggacaagauuaccuucgaagccacgggaaaccugguggugccucgcuacgcguuugccauggagagaaacgcuggcuccgggaucauuaucagcgauacacccguccaugacugcaauaccacaugucagaccccuaaaggagccaucaacaccucucuccccuuccaaaauauucacccgaucacaauuggcaagugcccuaaguaugugaaaagcacgaagcugcggcuugcuaccggccugcgcaacguucccuccauccagucuagagggcucuuuggagccauugccggcuucaucgaagggggauggacaggcaugguggacgggugguacggauaucaucaccagaaugagcagggcagcggcuacgcugcggaucugaaauccacccaaaacgccaucgacgagauuacaaauaaggucaacagcgugaucgaaaagaugaauacccaguuuacggcuguugggaaggaguucaaccaccuugaaaagcggauugagaaucugaacaaaaagguggaugacggauuccucgauaucuggacauacaaugccgaacugcugguccuccuggagaacgagcgcacccuugacuaucaugauucuaaugugaaaaaccuguacgaaaaggucagaucccagcucaaaaacaaugccaaggagauuggcaacggguguuuugaguucuaucacaagugcgacaauaccuguauggaaagcgugaaaaacggaacauacgauuauccuaaguacucugaagaggcuaaacugaaucgggaggaaaucgacggcguuaaacuugaguccacccgcaucuaucagauucuggccaucuacagcacaguggcguccucucucguccuggugguuagccugggggcuauuuccuuuuggaugugcucuaacggcagccuccaaugcagaaucuguauuuga

SEQ ID NO: 191427 - RNA, 1701 nt, Artificial Sequence; identical to SEQ ID NO: 191426
  derived and/or modified sequence opt5 from hemagglutinin__InfluenzaA__AFF57168

SEQ ID NO: 191428 - RNA, 1701 nt, Artificial Sequence
  derived and/or modified sequence opt5 from hemagglutinin__InfluenzaA__AFF57172
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgaggacgcuuacguguucgugggcuccagcagauauucuaagaaauuuaagccugagauugccauccggccgaaaguccgcgauagagaagggcggaugaauuacuauuggacacugguugagcccggagacaagauuaccuucgaagcuacgggcaaccugguggugccucgcuacgccuuugcgauggagagaaacgccggguccggaaucauuaucagcgauacacccguccaugacugcaauaccacaugucagaccccuaaaggcgcuaucaacaccucucuccccuuccaaaauauucacccgaucacaauuggcaagugcccuaaguaugugaaaagcacgaagcugcggcuugccaccgggcugcgcaacguucccuccauccagucuagaggacucuuuggcgcuauugccggguucaucgaaggaggcuggacagggaugguggacggaugguacggcuaucaucaccagaaugagcagggcagcggguacgccgcugaucugaaauccacccaaaacgcgaucgacgagauuacaaauaaggucaacagcgugaucgaaaagaugaauacccaguuuacggccguuggaaaggaguucaaccaccuugaaaagcggauugagaaucugaacaaaaagguggaugacggcuuccucgauaucuggacauacaaugcugaacugcugguccuccuggagaacgagcgcacccuugacuaucaugauucuaaugugaaaaaccuguacgaaaaggucagaucccagcucaaaaacaaugccaaggagauugggaacggauguuuugaguucuaucacaagugcgacaauaccuguauggagagcgugaaaaacggcacauacgauuauccuaaguacucugaagaggccaaacugaaucgggaggaaaucgacgggguuaaacuugaguccacccgcaucuaucagauucuggcuaucuacagcacaguggccuccucucucguccuggugguuagccugggcgcgauuuccuuuuggaugugcucuaacggaagccuccaaugcagaaucuguauuuga

SEQ ID NO: 191429 - RNA, 1701 nt, Artificial Sequence
  derived and/or modified sequence opt5 from hemagglutinin__InfluenzaA__AFF57176
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuacccuaaacuguccaagagcuauauuaaugacaagggcaaagaggugcuuguccugugggggauccaccaccccuccaccucugccgaucaacagagccucuaccagaacgcugacgccuacguguucgugggauccagcagauauucuaagaaauuuaagccugagauugcuauccggccgaaaguccgcgauagagaaggccggaugaauuacuauuggacacugguugagcccggggacaagauuaccuucgaagccacgggaaaccugguggugccucgcuacgcguuugccauggagagaaacgcuggcuccgggaucauuaucagcgauacacccguccaugacugcaauaccacaugucagaccccuaaaggagccaucaacaccucucuccccuuccaaaauauucacccgaucacaauuggcaagugcccuaaguaugugaaaagcacgaagcugcggcuugcuaccggccugcgcaacguucccuccauccagucuagagggcucuuuggagccauugccggcuucaucgaagggggauggacaggcaugguggacgggugguacggauaucaucaccagaaugagcagggcagcggcuacgcugcggaucugaaauccacccaaaacgccaucgacgagauuacaaauaaggucaacagcgugaucgaaaagaugaauacccaguuuacggcuguugggaaggaguucaaccaccuugaaaagcggauugagaaucugaacaaaaagguggaugacggauuccucgauaucuggacauacaaugccgaacugcugguccuccuggagaacgagcgcacccuugacuaucaugauucuaaugugaaaaaccuguacgaaaaggucagaucccagcucaaaaacaaugccaaggagauuggcaacggguguuuugaguucuaucacaagugcgacaauaccuguauggagagcgugaaaaacggaacauacgauuauccuaaguacucugaagaggcuaaacugaaucgggaggaaaucgacggcguuaaacuugaguccacccgcaucuaucagauucuggccaucuacagcacaguggcguccucucucguccuggugguuagccugggggcuauuuccuuuuggaugugcucuaacggcagccuccaaugcagaaucuguauuuga

SEQ ID NO: 191430 - RNA, 1701 nt, Artificial Sequence
  derived and/or modified sequence opt5 from hemagglutinin__InfluenzaA__AFF57184
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuaccaaaaacuguccaagagcuauauuaaugacaagggcaaagaggugcuuguccugugggggauccaccacccuuccaccucugccgaucagcagagccucuaccagaacgcugacgccuacguguucgugggauccagcagauauucuaagaaauuuaagcccgagauugcuauccggccuaaaguccgcgauagagaaggccggaugaauuacuauuggacacugguugagccgggggacaagauuaccuucgaagccacgggaaaccugguggugccccgcuacgcguuugccauggagagaaacgcuggcuccgggaucauuaucagcgauacaccuguccaugacugcaauaccacaugucaaacccccaaaggagccaucaacaccucucucccuuuccagaauauucaccccaucacaauuggcaagugcccgaaguaugugaaaagcacgaagcugcggcuugcuaccggccugcgcaacguuccuuccauccagucuagagggcucuuuggagccauugccggcuucaucgaagggggauggacaggcaugguggacgggugguacggauaucaucaccagaaugagcaaggcagcggcuacgcugcggaucugaaauccacccagaacgccaucgacgagauuacaaauaaggucaacagcgugaucgaaaagaugaauacccaguuuacggcuguugggaaggaguucaaccaccuugaaaagcggauugagaaucugaacaaaaagguggaugacggauuccucgauaucuggacauacaaugccgaacugcugguccuccuggagaacgagcgcacccuugacuaucaugauucuaaugugaaaaaccuguacgaaaaggucagaucccagcucaaaaacaaugccaaggagauuggcaacggguguuuugaguucuaucacaagugcgacaauaccuguauggagagcgugaaaaacggaacauacgauuaucccaaguacucugaagaggcuaaacugaaucgggaggaaaucgacggcguuaaacuugaguccacccgcaucuaucaaauucuggccaucuacagcacaguggcguccucucucguccuggugguuagccugggggcuauuuccuuuuggaugugcucuaacggcagccuccagugcagaaucuguauuuga

SEQ ID NO: 191431 - RNA, 1701 nt, Artificial Sequence; identical to SEQ ID NO: 191423
  derived and/or modified sequence opt5 from hemagglutinin__InfluenzaA__AFF57188

SEQ ID NO: 191432 - RNA, 1707 nt, Artificial Sequence
  derived and/or modified sequence opt5 from hemagglutinin__InfluenzaA__AFF60787
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccgaaguuaauggccaaagcgggcggauggaguucuuuuggacaauccugaaaccuaacgacgccauuaauuucgaauccaacggaaauuuuaucgcgcccgaguacgccuauaagauugugaaaaagggcgauucuaccaucaugaaaagcgaacucgaguacgggaacugcaauacgaagugucagacaccuaugggagcuaucaacuccagcaugcccuuccauaauauucacccgcugaccaucggcgagugcccuaaauaugugaagucuaaccgccuuguccuggccacagggcucagaaauagcccccagcgggaacgcagacggaagaaacgcggacuguuuggcgcuauugccggcuucaucgaagggggauggcagggcaugguggacgggugguacggauaucaucacuccaacgaacaaggcucuggguacgcggccgacaaggagagcacccagaaagcuauugauggaguuaccaauaaggugaacuccaucaucgacaaaaugaauacacaguuugaagccgucggcagagaguucaacaaccuugagcggcgcauugaaaaucugaacaagaagauggaggauggcuuccucgacguguggacguauaaugcugaacugcugguucucauggagaacgaaagaacccuggauuuucacgacucuaaugugaaaaaccuuuacgauaagguccggcugcaacucagagacaaugccaaagagcuggggaacggauguuucgaguuuuaccauaagugcgauaaugaauguauggagagcgugcgcaacggcacauaugacuacccucaguauuccgaagaggcccggcuuaaaagagaggaaaucagcggggucaagcuggagucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 191433 - RNA, 1701 nt, Artificial Sequence
  derived and/or modified sequence opt5 from hemagglutinin__InfluenzaA__AFG29042
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuuuuccucugacaacggcacgugcuauccgggggauuucauugacuacgaagaacugcgggagcagcuuagcuccgucagcucuuuugaacgcuucgagaucuuucccaagaccuccagcuggccuaaucacgauucuaacaagggagugacagccgcuuguccccaugccggcgcgaaauccuucuauaagaaucugaucuggcucguuaaaaagggcaacagcuacccuaaacugucuaaguccuauauuaaugacaaggggaaagaagugcuuguccuguggggaauccaccaccccagcaccuccgccgaucaacagucucucuaccagaacgcugacgccuacguguuugugggcacaagcagauauuccaagaaauucaagccugagauugcuauccggccgaaaguccgcgaucaggaggggagaaugaauuacuauuggacccugauugaacccggagacaagaucacguuugaggccacaggcaaccugguugugccucgguacgcguucgccauggaacgcaacgcugggagcggaauuaucaucucugauacccccgugcaugacugcaauacaaccugucaaaccccuaaaggcgccauuaacacaucccuccccuuucagaauauccacccgauuacgaucggcaagugcccuaaguaugucaaaagcaccaagcugagacuugcuacagggcugcggaacgugcccucuauucagagccgcggacucuucggcgccaucgccggguuuaucgagggaggcuggaccgggaugguugacggaugguacggcuaucaucaccagaaugaacaaggcuccggguacgcugcggaucugaaaucuacacagaacgccauugacgagaucaccaauaaggugaacagcgucauugagaaaaugaauacgcaguucacagcugugggaaaggaguucaaccaccuugagaagagaaucgaaaaucugaacaaaaagguugaugacggcuuucucgauauuuggaccuacaaugccgagcugcuggugcuccuggaaaacgagcggacccuugacuaucaugauuccaaugucaaaaaccuguacgagaaggugcgcagccagcucaaaaacaaugccaaggaaaucgggaacggauguuucgaguuuuaucacaagugcgacaauacauguauggaaucugucaaaaacggcaccuacgauuauccuaaguacuccgaggaagcuaaacugaauagagaggagaucgacggggugaaacuugaaagcacacggauuuaucaaauccuggccauuuacucuacgguugcguccagccucgugcuggucgugucccugggcgcuaucucuuucuggaugugcagcaacggaucccuccagugccgcauuuguaucuga

SEQ ID NO: 191434 - RNA, 1701 nt, Artificial Sequence
  derived and/or modified sequence opt5 from hemagglutinin__InfluenzaA__AFG29044
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccgaacuccgacaauggcacgugcuaucccggggauuuuauugacuacgaagaacugcgggagcagcuuucuagcgucuccagcuucgaacgcuuugagaucuucccuaagaccucuuccuggcccaaccacgauagcaauaagggagugacagccgcuuguccucaugccggcgcgaaaucuuuuuauaagaaccugaucuggcucguuaaaaagggcaauuccuaccccaaacugagcaagucuuauauuaacgacaaggggaaagaagugcuuguccuguggggaauccaccacccuccgaccuccacagaucaacagagccucuaccagaaugccgacgcuuacguguucgugggcaccuccagauauucuaagaaauuuaagcccgagauugccauccggccuaaaguccgcgggcaggagggaagaaugaacuacuauuggacgcugguugaacccggcgauaagauuacauucgaggcuaccgggaaccugguggugccucgguacgccuuugcgauggaacgcaaugccggaagcggcaucauuaucuccgacacacccguccaugauugcaacaccaccugucaaacaccgaaaggcgcuaucaauacgagccucccuuuccagaacauucaccccaucaccauugggaagugcccuaaguaugugaaaucuacaaagcugagacuugccaccggacugcggaauguucccuccauccagagccgcggccucuuuggggcuauugccggauucaucgagggcggguggacaggaaugguggacggcugguacggcuaucaucaccagaacgaacaagggucuggauacgccgcugaccugaaaagcacccagaaugcgaucgauaagauuacgaacaaagucaauuccgugaucgagaagaugaacacacaguuuaccgccguuggcaaggaguucaaucaccuugagaaaagaauugagaaccugaauaagaaaguggacgauggguuccucgacaucuggaccuacaacgcugaacugcugguccuccuggagaaugaacggacacuugauuaucaugacucuaacgugaagaaccuguacgagaaaguccgcagccagcucaagaauaacgccaaggagauuggaaauggcuguuuugaguucuaucacaaaugcgauaacaccuguauggaauccgugaagaaugggacauacgacuaucccaaauacagcgaagaggccaagcugaacagagaagagaucgauggcguuaaacuugagucuacgcggaucuaucaaauucuggcuaucuacuccaccguggccagcucucucguccuggugguuucccugggagcgauuagcuuuuggaugugcuccaauggcucucuccagugccgcaucuguauuuga

SEQ ID NO: 191435 - RNA, 1701 nt, Artificial Sequence; identical to SEQ ID NO: 185693
  derived and/or modified sequence opt5 from hemagglutinin__InfluenzaA__AFG31060

SEQ ID NO: 191436 - RNA, 1701 nt, Artificial Sequence; identical to SEQ ID NO: 188248
  derived and/or modified sequence opt5 from hemagglutinin__InfluenzaA__AFG31070

SEQ ID NO: 191437 - RNA, 1701 nt, Artificial Sequence; identical to SEQ ID NO: 185680
  derived and/or modified sequence opt5 from hemagglutinin__InfluenzaA__AFG31080

SEQ ID NO: 191438 - RNA, 1701 nt, Artificial Sequence
  derived and/or modified sequence opt5 from hemagglutinin__InfluenzaA__AFG31100
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucugaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccaugacugcaauacaaccugucaaaccccuaaaggcgccaucaacacaucccugcccuuccagaauauucacccgaucacgauuggcaagugcccuaaguaugugaaaagcaccaaacuuagacuggcuacagggcuccggaacguucccucuauccagagccgcggacuguuuggcgccauugccggguucaucgagggaggcuggaccgggaugguggacggaugguacggcuaucaucaccagaaugaacaaggcuccggguacgcugcggaucuuaagucuacacagaacgccaucgacgagauuaccaauaaggucaacagcgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauuccaaugugaaaaaccucuacgagaagguccgcagccagcugaaaaacaaugccaaggaaauugggaacggauguuuugaguucuaucacaagugcgacaauacauguauggaaucugugaaaaacggcaccuacgauuauccuaaguacuccgaggaagcuaaacuuaauagagaggagaucgacgggguuaagcuggaaagcacacggaucuaucaaauucucgccaucuacucuacgguggcguccagccugguccugauugugucccucggcgcuaucucuuuuuggaugugcagcaacggaucccugcagugccgcauuuguaucuga

SEQ ID NO: 191439 - RNA, 1701 nt, Artificial Sequence; identical to SEQ ID NO: 185693
  derived and/or modified sequence opt5 from hemagglutinin__InfluenzaA__AFG31110

SEQ ID NO: 191440 - RNA, 1701 nt, Artificial Sequence; identical to SEQ ID NO: 185935
  derived and/or modified sequence opt5 from hemagglutinin__InfluenzaA__AFG31120

SEQ ID NO: 191441 - RNA, 1701 nt, Artificial Sequence; identical to SEQ ID NO: 185935
  derived and/or modified sequence opt5 from hemagglutinin__InfluenzaA__AFG31130

SEQ ID NO: 191442 - RNA, 1701 nt, Artificial Sequence; identical to SEQ ID NO: 185935
  derived and/or modified sequence opt5 from hemagglutinin__InfluenzaA__AFG31140

SEQ ID NO: 191443 - RNA, 1701 nt, Artificial Sequence; identical to SEQ ID NO: 186795
  derived and/or modified sequence opt5 from hemagglutinin__InfluenzaA__AFG31150

SEQ ID NO: 191444 - RNA, 1701 nt, Artificial Sequence; identical to SEQ ID NO: 186795
  derived and/or modified sequence opt5 from hemagglutinin__InfluenzaA__AFG31160

SEQ ID NO: 191445 - RNA, 1701 nt, Artificial Sequence; identical to SEQ ID NO: 185693
  derived and/or modified sequence opt5 from hemagglutinin__InfluenzaA__AFG31170

SEQ ID NO: 191446 - RNA, 1701 nt, Artificial Sequence; identical to SEQ ID NO: 185693
  derived and/or modified sequence opt5 from hemagglutinin__InfluenzaA__AFG31180

SEQ ID NO: 191447 - RNA, 1701 nt, Artificial Sequence; identical to SEQ ID NO: 185693
  derived and/or modified sequence opt5 from hemagglutinin__InfluenzaA__AFG31190

SEQ ID NO: 191448 - RNA, 1701 nt, Artificial Sequence; identical to SEQ ID NO: 185693
  derived and/or modified sequence opt5 from hemagglutinin__InfluenzaA__AFG31200

SEQ ID NO: 191449 - RNA, 1701 nt, Artificial Sequence; identical to SEQ ID NO: 185693
  derived and/or modified sequence opt5 from hemagglutinin__InfluenzaA__AFG31210

SEQ ID NO: 191450 - RNA, 1701 nt, Artificial Sequence; identical to SEQ ID NO: 185693
  derived and/or modified sequence opt5 from hemagglutinin__InfluenzaA__AFG31220

SEQ ID NO: 191451 - RNA, 1701 nt, Artificial Sequence; identical to SEQ ID NO: 188248
  derived and/or modified sequence opt5 from hemagglutinin__InfluenzaA__AFG31230

SEQ ID NO: 191452 - RNA, 1701 nt, Artificial Sequence; identical to SEQ ID NO: 185693
  derived and/or modified sequence opt5 from hemagglutinin__InfluenzaA__AFG31240

SEQ ID NO: 191453 - RNA, 1701 nt, Artificial Sequence; identical to SEQ ID NO: 185693
  derived and/or modified sequence opt5 from hemagglutinin__InfluenzaA__AFG31250

SEQ ID NO: 191454 - RNA, 1701 nt, Artificial Sequence; identical to SEQ ID NO: 185693
  derived and/or modified sequence opt5 from hemagglutinin__InfluenzaA__AFG31260

SEQ ID NO: 191455 - RNA, 1701 nt, Artificial Sequence; identical to SEQ ID NO: 185693
  derived and/or modified sequence opt5 from hemagglutinin__InfluenzaA__AFG31270

SEQ ID NO: 191456 - RNA, 1701 nt, Artificial Sequence; identical to SEQ ID NO: 185693
  derived and/or modified sequence opt5 from hemagglutinin__InfluenzaA__AFG31280

SEQ ID NO: 191457 - RNA, 1701 nt, Artificial Sequence; identical to SEQ ID NO: 185693
  derived and/or modified sequence opt5 from hemagglutinin__InfluenzaA__AFG31290

SEQ ID NO: 191458 - RNA, 1701 nt, Artificial Sequence
  derived and/or modified sequence opt5 from hemagglutinin__InfluenzaA__AFG31300
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauuaacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaccaucagaacgaacaaggcucuggguacgcugcggaucugaaaagcacacagaaugccaucgacgagauuaccaacaaggucaauuccgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucacgauagcaacgugaaaaaccuguacgagaagguccgcucucagcucaaaaauaacgccaaggaaauugggaauggauguuuugaguucuaucauaagugcgacaacacauguauggaauccgugaaaaauggcaccuacgauuauccuaaguacagcgaggaagcuaaacugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 191459 - RNA, 1701 nt, Artificial Sequence; identical to SEQ ID NO: 188248
  derived and/or modified sequence opt5 from hemagglutinin__InfluenzaA__AFG31310

SEQ ID NO: 191460 - RNA, 1701 nt, Artificial Sequence; identical to SEQ ID NO: 185693
  derived and/or modified sequence opt5 from hemagglutinin__InfluenzaA__AFG31323

SEQ ID NO: 191461 - RNA, 1701 nt, Artificial Sequence; identical to SEQ ID NO: 185693
  derived and/or modified sequence opt5 from hemagglutinin__InfluenzaA__AFG31333

SEQ ID NO: 191462 - RNA, 1701 nt, Artificial Sequence; identical to SEQ ID NO: 185693
  derived and/or modified sequence opt5 from hemagglutinin__InfluenzaA__AFG31343

SEQ ID NO: 191463 - RNA, 1701 nt, Artificial Sequence; identical to SEQ ID NO: 185693
  derived and/or modified sequence opt5 from hemagglutinin__InfluenzaA__AFG31353

SEQ ID NO: 191464 - RNA, 1701 nt, Artificial Sequence; identical to SEQ ID NO: 185693
  derived and/or modified sequence opt5 from hemagglutinin__InfluenzaA__AFG31363

SEQ ID NO: 191465 - RNA, 1701 nt, Artificial Sequence; identical to SEQ ID NO: 185693
  derived and/or modified sequence opt5 from hemagglutinin__InfluenzaA__AFG31376

SEQ ID NO: 191466 - RNA, 1701 nt, Artificial Sequence; identical to SEQ ID NO: 185693
  derived and/or modified sequence opt5 from hemagglutinin__InfluenzaA__AFG31386

SEQ ID NO: 191467 - RNA, 1701 nt, Artificial Sequence; identical to SEQ ID NO: 185693
  derived and/or modified sequence opt5 from hemagglutinin__InfluenzaA__AFG31396

SEQ ID NO: 191468 - RNA, 1701 nt, Artificial Sequence; identical to SEQ ID NO: 185693
  derived and/or modified sequence opt5 from hemagglutinin__InfluenzaA__AFG31406

SEQ ID NO: 191469 - RNA, 1701 nt, Artificial Sequence; identical to SEQ ID NO: 185693
  derived and/or modified sequence opt5 from hemagglutinin__InfluenzaA__AFG31416

SEQ ID NO: 191470 - RNA, 1701 nt, Artificial Sequence; identical to SEQ ID NO: 185693
  derived and/or modified sequence opt5 from hemagglutinin__InfluenzaA__AFG31426

SEQ ID NO: 191471 - RNA, 1701 nt, Artificial Sequence; identical to SEQ ID NO: 185693
  derived and/or modified sequence opt5 from hemagglutinin__InfluenzaA__AFG31436

SEQ ID NO: 191472 - RNA, 1701 nt, Artificial Sequence; identical to SEQ ID NO: 185693
  derived and/or modified sequence opt5 from hemagglutinin__InfluenzaA__AFG31446

SEQ ID NO: 191473 - RNA, 1701 nt, Artificial Sequence; identical to SEQ ID NO: 185693
  derived and/or modified sequence opt5 from hemagglutinin__InfluenzaA__AFG31456

SEQ ID NO: 191474 - RNA, 1701 nt, Artificial Sequence; identical to SEQ ID NO: 185693
  derived and/or modified sequence opt5 from hemagglutinin__InfluenzaA__AFG31466

SEQ ID NO: 191475 - RNA, 1701 nt, Artificial Sequence; identical to SEQ ID NO: 186795
  derived and/or modified sequence opt5 from hemagglutinin__InfluenzaA__AFG31486

SEQ ID NO: 191476 - RNA, 1701 nt, Artificial Sequence; identical to SEQ ID NO: 185693
  derived and/or modified sequence opt5 from hemagglutinin__InfluenzaA__AFG31496

SEQ ID NO: 191477 - RNA, 1701 nt, Artificial Sequence; identical to SEQ ID NO: 185693
  derived and/or modified sequence opt5 from hemagglutinin__InfluenzaA__AFG31506

SEQ ID NO: 191478 - RNA, 1701 nt, Artificial Sequence; identical to SEQ ID NO: 185693
  derived and/or modified sequence opt5 from hemagglutinin__InfluenzaA__AFG31516

SEQ ID NO: 191479 - RNA, 1701 nt, Artificial Sequence; identical to SEQ ID NO: 185784
  derived and/or modified sequence opt5 from hemagglutinin__InfluenzaA__AFG31526

SEQ ID NO: 191480 - RNA, 1701 nt, Artificial Sequence; identical to SEQ ID NO: 185693
  derived and/or modified sequence opt5 from hemagglutinin__InfluenzaA__AFG31536

SEQ ID NO: 191481 - RNA, 1701 nt, Artificial Sequence; identical to SEQ ID NO: 188248
  derived and/or modified sequence opt5 from hemagglutinin__InfluenzaA__AFG31546

SEQ ID NO: 191482 - RNA, 1701 nt, Artificial Sequence; identical to SEQ ID NO: 188248
  derived and/or modified sequence opt5 from hemagglutinin__InfluenzaA__AFG31556

SEQ ID NO: 191483 - RNA, 1701 nt, Artificial Sequence; identical to SEQ ID NO: 185693
  derived and/or modified sequence opt5 from hemagglutinin__InfluenzaA__AFG31566

SEQ ID NO: 191484 - RNA, 1701 nt, Artificial Sequence; identical to SEQ ID NO: 185935
  derived and/or modified sequence opt5 from hemagglutinin__InfluenzaA__AFG31586

SEQ ID NO: 191485 - RNA, 1701 nt, Artificial Sequence; identical to SEQ ID NO: 185935
  derived and/or modified sequence opt5 from hemagglutinin__InfluenzaA__AFG31596

SEQ ID NO: 191486 - RNA, 1701 nt, Artificial Sequence; identical to SEQ ID NO: 185935
  derived and/or modified sequence opt5 from hemagglutinin__InfluenzaA__AFG31606

SEQ ID NO: 191487 - RNA, 1701 nt, Artificial Sequence; identical to SEQ ID NO: 185935
  derived and/or modified sequence opt5 from hemagglutinin__InfluenzaA__AFG31616

SEQ ID NO: 191488 - RNA, 1701 nt, Artificial Sequence; identical to SEQ ID NO: 185935
  derived and/or modified sequence opt5 from hemagglutinin__InfluenzaA__AFG31626

SEQ ID NO: 191489 - RNA, 1701 nt, Artificial Sequence; identical to SEQ ID NO: 185693
  derived and/or modified sequence opt5 from hemagglutinin__InfluenzaA__AFG31636

SEQ ID NO: 191490 - RNA, 1701 nt, Artificial Sequence; identical to SEQ ID NO: 185693
  derived and/or modified sequence opt5 from hemagglutinin__InfluenzaA__AFG31646

SEQ ID NO: 191491 - RNA, 1701 nt, Artificial Sequence; identical to SEQ ID NO: 186857
  derived and/or modified sequence opt5 from hemagglutinin__InfluenzaA__AFG31656

SEQ ID NO: 191492 - RNA, 1701 nt, Artificial Sequence; identical to SEQ ID NO: 186857
  derived and/or modified sequence opt5 from hemagglutinin__InfluenzaA__AFG31666

SEQ ID NO: 191493 - RNA, 1701 nt, Artificial Sequence
  derived and/or modified sequence opt5 from hemagglutinin__InfluenzaA__AFG71865
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucgacuguacccucauugaugcccugcugggcgacccccauugcgauguguuucagaaugagacgugggaccucuucgucgaacggucuaaagccuuuagcaacuguuauccuuacgaugugcccgacuaugcuucccugcgcucucuuguugccagcuccgggacccuggaguucaucacagaaggauuuaccuggacaggcgugacccagaauggcgggagcaacgcuugcaagagaggaccuggcauuggguucuuuucucggcucaauuggcugacgaaauccggaagcacauaccccguccuuaacgugaccaugccuaauaacgauaauuucgacaagcuguauaucuggggcguucaccauccgucuacaaaccaagagcagaccucccucuacgugcaggccagcgggcgcgucaccgugucuacaagacggucccagcaaacgauuauccccaacauuggaagccgcccuugggugagaggccuguccucucggaucagcaucuauuggaccauugucaagcccggcgauguucuggugaucaauuccaacgggaaucucauugcgccucgcggauacuuuaaaaugagaacaggcaagagcucuaucaugcgguccgacgcccccauugacaccuguaucagcgagugcaucacaccgaacgggucuauuccuaaugauaaacccuuccagaacgugaauaagaucaccuacggagcuuguccuaaauaugucaagcagaacacgcugaaacuugccacaggcaugcgcaaugugcccgaaaagcagaccagagggcuguuuggagcuauugccggcuucaucgagaacggcugggaagggaugauugacggaugguacggcuuucggcaccaaaauagcgaggggaccggacaggcggccgaucucaaguccacacaggcugccaucgaccaaaucaacggcaaacugaaucgcguuauugagaagaccaacgaaaaauuccaccagaucgagaaggaguucucugaaguggaagggcggauucaggaucuugagaaauaugucgaggacacaaagaucgaucuguggagcuacaaugcugaacuccugguggcccuggagaaccagcauacgauugaccucaccgauuccgaaaugaacaagcuguuugagaaaacaagaagacaacuucgcgaaaaugccgaggacaugggcaacggaugcuucaagaucuaucacaaaugugauaaugcuugcauugagagcauccggaacggcaccuacgaccaugacguuuauagagaugaagcgcugaauaaccgcuuucagaucaaggggguggagcucaaaucuggauacaaggacuggauucuguggaucuccuucgccauuagcugcuuucuucugugugucgugcuccugggcuucaucaugugggcuugccagcgggggaauauuagauguaacaucugcaucuga

SEQ ID NO: 191494 - RNA, 1701 nt, Artificial Sequence; identical to SEQ ID NO: 184580
  derived and/or modified sequence opt5 from hemagglutinin__InfluenzaA__AFG71876

SEQ ID NO: 191495 - RNA, 1701 nt, Artificial Sequence
  derived and/or modified sequence opt5 from hemagglutinin__InfluenzaA__AFG71898
augaagaccaucauugcccugagcuaccucuucugccuggcuuuuggccaggaccuucccgggaacgauaauuccacagccacgcugugucucggacaccaugcggugccuaacggcacccuggucaaaacaaucaccgacgaucaaauugagguuacaaaugcuaccgaacuugugcagucuagcuccacagggaagaucugcaacaauccgcaccggauucuggacggaaucgauuguacccucaucgacgcccugcugggcgauccccauugcgacguguuccagaacgagacgugggaucucuuugucgaaagaucuaaagccuucagcaauuguuauccuuacgacgugcccgauuaugcuucccugcgcucucuuguugccagcuccgggacccuggaguuuacaaccgaaggauucacauggaccggcgugacgcagaacggcgggagcaaugcuugcaagagaggaccuggcucuggguuuuucucccggcucaacuggcugacaaaaagcggaucuaccuaccccguccuuaaugugacaauguccaacaaugacaacuuugauaagcuguauauuuggggcguucaccauccuagcaccaaucaagagcagaccucucucuacgugcaggccuccgggcgcgucacagugagcacgagacggucccagcaaaccaucauuccgaacaucggaucucgccccugggugagaggccugagcucccggauuagcaucuauuggacaauugucaagccuggcgacguucuggugaucaacucuaaugggaaccucaucgcgccccgcggauacuucaaaaugagaaccggcaaguccagcauuaugcggucugacgccccuaucgauacaugugugagcgagugcauuacccccaauggguccaucccgaacgacaaaccuuuucagaaugucaacaagauuacguacggagcuugucccaaauaugugaagcagaauacacugaaacuugccaccggcaugcgcaacguuccugaaaagcagaccagagggcuguucggagcuaucgccggcuuuaucgagaauggcugggaagggaugauugauggaugguacggcuuccggcaccaaaacucugaggggacaggacaggcggccgaccucaagagcacccaggcugccaucgaucaaauuaauggcaaacugaaccgcgugaucgagaagacaaaugaaaaauuccaccagauugagaaggaauuuuccgaggucgaagggagaauccaggaccuugagaaauauguggaggauacgaagaucgaccuguggagcuacaacgcugaacuccugguugcccuggagaaucagcauaccauugaucucacagacucugaaaugaacaagcuguucgagaaaacccggagacaacuucgcgaaaacgccgaggauaugggcaauggaugcuuuaagaucuaucacaaaugugacaacgcuugcauugaguccauccggaauggcacauacgaccaugauguguauagagacgaagcgcugaacaaucgcuuccagauuaagggggucgagcucaaaagcggauacaaggauuggauccuguggauuucuuuugccaucuccugcuuccuucugugugugguccuccugggcuuuaucaugugggcuugccagcgggggaacauuagauguaauaucugcauuuga

SEQ ID NO: 191496 - RNA, 1701 nt, Artificial Sequence
  derived and/or modified sequence opt5 from hemagglutinin__InfluenzaA__AFG71920
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucaauuguacccucauugacgcccugcugggcgauccccauugcgacguguuucaggaugagacgugggaccucuucgucgaacggucuaaagccuuuagcaacuguuauccuuacgaugugcccgacuaugcuucccugcgcucucuuaucgccagcuccgggacccuggaguucauuacagaaggauuuaccuggacaggcguuacccagaauggcgggagcaacgcuugcaagagaggaccuggcucuggguucuuuucccggcucaauuggcugacgaaaagcggaucuacauaccccgugcuuaacgucaccaugccuaauaacgauaauuucgacaagcuguauaucuggggcgugcaccauccguccacaaaccaagagcagaccagccucuacguucaggccucugggcgcgugaccgucuccacaagacggagccagcaaacgauuauccccaacauuggaucccgcccuugggugagaggccugucuagccggaucuccaucuauuggaccauugugaagcccggcgauguccugguuaucaauagcaacgggaaucucauugcgccucgcggauacuuuaaaaugagaacaggcaagucuuccaucaugcggagcgacgcccccauugacaccuguaucucugagugcaucacaccgaacgggagcauuccuaaugauaaacccuuccagaacgugaauaagaucaccuacggagcuuguccuaaauaugugaagcagaacacgcugaaacuugccacaggcaugcgcaauguccccgaaaagcagaccagagggcuguuuggagcuauugccggcuucaucgagaacggcugggaagggaugauugacggaugguacggcuuucggcaccaaaauuccgaggggaccggacaggcggccgaucucaagucuacacaggcugccaucgaccaaaucaacggcaaacugaaucgcgugauugagaagaccaacgaaaaauuccaccagaucgagaaggaguucagcgaaguugaagggcggauucaggaucuugagaaauauguggaggacacaaagaucgaucugugguccuacaaugcugaacuccuggucgcccuggagaaccagcauacgauugaccucaccgauagcgaaaugaacaagcuguuugagaaaacaagaagacaacuucgcgaaaaugccgaggacaugggcaacggaugcuucaagaucuaucacaaaugugauaaugcuugcauugagucuauccggaacggcaccuacgaccaugacguguauagagaugaagcgcugaauaaccgcuuucagaucaaggggguugagcucaaauccggauacaaggacuggauucuguggaucagcuucgccauuucuugcuuucuucugugugugguccuccugggcuucaucaugugggcuugccagcgggggaauauuagauguaacaucugcaucuga

SEQ ID NO: 191497 - RNA, 1701 nt, Artificial Sequence
  derived and/or modified sequence opt5 from hemagglutinin__InfluenzaA__AFG71931
augaagaccaucauugcccugagcuacaucuucugccucgugauuggccaggaccugcccgggaacgaaaauuccacagcuacgcuuugucugggacaccaugccgucccuaacggcacccucguuaaaacaaucaccaaugaucaaauugaagugacaaacgcgaccgagcuggugcagucuagcuccacagggaagaucugcaauaacccgcacagaauccuugacggaauugauuguacccugaucgacgcucuccugggcgauccccauugcgacggguuucagaaugaaacgugggaucuguucgucgagcggucuaaagccuuuagcaacuguuauccuuacgacgugcccgauuaugccucccuccgcucucugguugcuagcuccggaacccuugaguucauuacagagggcuuuaccuggacaggcgugacccagaaugggggaagcaacgccugcaagagaggcccugggaucggauucuuuucucggcugaauuggcucacgaaauccggcagcacauaccccguccugaacgugaccaugccuaauaacgacaauuucgauaaacuuuauauuuggggaguucaccauccgucuacaaaccaagagcagaccucccuguacgugcaggcuagcgggcgcgucaccgugucuacaagacggucccagcaaacgaucauucccaacaucggcagccgcccuugggugagaggccucuccucucggaucagcauuuauuggaccaucgucaagcccggggacguucuggugauuaauuccaacggaaaucugaucgccccucgcggcuacuuuaaaaugagaacaggaaagagcucuauuaugcgguccgaugcgcccaucgacaccuguaucagcgaaugcauuacaccgaacgggucuaucccuaaugacaaacccuuccagaacgugaauaagauuaccuacggcgccuguccuaaauaugucaagcagaacacgcucaagcuggcuacagggaugcgcaaugugcccgagaaacagaccagaggacuuuuuggcgccaucgcuggcuucauugaaaacgggugggagggaaugaucgauggcugguacggguuucggcaccaaaauagcgagggaaccggccaggccgcggaccugaaguccacacaggccgcuaucgaucaaauuaacgggaaacucaaucgcguuaucgaaaagaccaacgagaaauuccaccagauugaaaaggaguucucugaaguggagggcagaauccaggaccuggagaaauaugucgaagauacaaagauugaccuuuggagcuacaaugccgagcugcucguggcucuggaaaaccagcauacgaucgaucugaccgacuccgagaugaacaagcucuuugaaaagacacggagacaacugcgcgagaaugccgaggauaugggaaacggcugcuucaagauuuaucacaaaugugacaaugccugcaucgaaagcauccggaacgggaccuacgaucaugacguuuauagagacgaggcucuuaauaaccgcuuucagauuaagggaguggaacugaaaucuggcuacaaggauuggauccucuggauuuccuucgcgaucagcugcuuucugcuuugugucgugcugcucggguucauuaugugggccugccagcggggaaauaucagauguaacaucugcauuuga

SEQ ID NO: 191498 - RNA, 1701 nt, Artificial Sequence
  derived and/or modified sequence opt5 from hemagglutinin__InfluenzaA__AFG71942
augaagaccaucauugcccugagcuacaucuucuaucucgcucugucccaggaccuucccggcaacgauaauucuaaagccacacugugccucgggcaccaugcggugccuaacggaacgcuggucaagaccauuacagacgaucaaaccgagguuacaaaugcuaccgaacuugugcagagcuccucuacaggcaaaaucuguaacaauccgcaccggauucuggacgggauggauugcacccucaucgacgcccugcugggagauccccauugugacguguuucagaacgagacgugggaucucuucgucgaaagaagcaaggccuuuuccaauugcuacccuuaugacgugcccgauuacgcuucucugcgcagccuuguugccuccagcggcacccuggaguucaucacagaaggguuuaccuggacagaggugacccagaacggaggcucuauugcuuguaaaagaggcccugacuccggguucuuuagccggcucaauuggcugacgaagucuggacgcacauaucccguccuuaacgugaccaugccuaauaacgauaauuucgacaagcuguacaucuggggcguucaccauccguccacagaccaagagcagaccaaccucuaugugcagaccagcgggagagucacagugucuacgcggcgcucccagcaaaccauuauccccaauauuggaagcagaccuugggugcggggccuguccucucgcaucagcauuuacuggacaaucgucaaacccggggauguucuggugaucaacuccaacggaaaucucauugccccuagaggcuacuuuaagaugcggaccggcaaaagcucuaucaugcgcuccgacgcgcccauugauacaugcaucagcgaauguauuaccccgaacgggucuaucccuaaugacaagcccuuccagaacgugaauaaaaucacguauggagccugcccuaaguacgucaagcagaacacacugaaacuugcuaccggcaugagaaaugugcccgagaagcagacccgggggcuguuuggagccauugcuggcuucaucgaaaacgggugggagggaaugauugauggcugguauggcuuucgccaccaaaauagcgaggggacaggacaggccgcggaccucaaauccacccaggccgcuaucgaucaaauuaacggcaagcugaauagaaucaucgagaaaacaaacgaaaaguuccaccagauugaaaaagaguucucugaaguugaggggcggauccaggaccuugagaaguacguggaagauacgaagauugaccuguggagcuauaaugccgagcuccuggucgcucuggaaaaccagcauaccaucgaucucacagacuccgagaugaauaaacuguuugaaaagaccagacgccaacuucgggagaacgccgaggacaugggaaacggcuguuucaaaauuuaccacaagugcgauaaugccuguaucgaaagcauuagaaacgggacauaugaccaugauguguaccgcgacgaggcucugaauaaccgguuucagaucaaaggcguugaacucaagucuggauacaaggauuggauccuguggauuuccuucgcgaucagcugcuuucuucugugcgugguccuccugggcuucauuaugugggccugucagagagggaauauccgcugcaacauuuguaucuga

SEQ ID NO: 191499 - RNA, 1701 nt, Artificial Sequence
  derived and/or modified sequence opt5 from hemagglutinin__InfluenzaA__AFG71953
augaagaccaucauugcccugagcuacaucuucugccucgugcugggccaggaccuucccgggaacgauaaauccacagcuacgcugugucucggacaccaugccgucccuaauggcacccugguuaagacaauuaccaacgaccaaaucgaggugacaaaugcgaccgaacuugugcagucuagcuccacagggaaaauuugcaacaauccgcacagaauccuggauggaaucgacuguacccucauugaugcucugcugggcgacccccauugcgauggguuucagaacgagacgugggaccucuucgucgaacggucuaaggccuuuagcaauuguuauccuuacgaugugcccgacuaugccucccugcgcucucuuguugcuagcuccggaacccuggaguucaucacagaaggcuuuaccuggacaggcgugacccagaacgggggaagcaaugccugcaaaagaggcccugggucuggauucuuuucccggcucaacuggcugacaaagagcggcucuacguaccccguccuuaaugugaccaugccuaacaaugauaacuucgacaagcuguauauuuggggaguucaccauccguccacaaaucaagagcagaccagccucuacgugcaggcuucugggcgcgucaccguguccacaaaaagaagccagcaaacgaucauucccaacaucggcucccggccuugggugcgcggccccucuagcagaauuuccaucuauuggaccacagucaagccuggggauauccugauuaucaacagcaauggaaaccugauugcgccccggggcuacuuuaaaaugcgcaccgggaagucuuccaucaugagaagcgacgccccgauuggagccuguaucucugagugcaucacaccuaauggcagcauucccaacgacaaaccuuuccagaauguuaacaagaucaccuacggggcuugucccaaguaugugaaacagaauacgcucaagcuggccacaggaaugcggaacgugcccgaaaaacagacccgcggccuuuuuggcgcuauugccggguucaucgagaauggaugggaaggcaugauugaugggugguacggauuuagacaccaaaacuccgagggcaccgggcaggcggccgaccugaagucuacacaggcugccaucgaucaaaucaauggcaaacucaaccgggucauugagaagaccaaugaaaaauuccaccagaucgagaaggaguucagcgaaguggaaggacgcauucaggaccuggagaaguauguugaggauacaaaaaucgaccuuugguccuacaacgcugaacugcucguggcccuggagaaucagcauacgauugaucugaccgacagcgaaaugaacaagcucuuugagaaaacaagacggcaacugagagaaaacgccgaggauaugggcaaugggugcuucaagaucuaucacaaaugugacaacgcuugcauuggaucuauccgcaauggcaccuacgaucaugacgucuaucgggacgaggcgcuuaacaauagauuucagaucaaggggguggaacugaaguccggauacaaagauuggauucucuggaucagcuucgccauuucuugcuuucugcuuuguguugugcugcucggcgucaucaugugggcuugccagaaggggaacauucgcuguaauaucugcaucuga

SEQ ID NO: 191500 - RNA, 1701 nt, Artificial Sequence; identical to SEQ ID NO: 183329
  derived and/or modified sequence opt5 from hemagglutinin__InfluenzaA__AFG71975

SEQ ID NO: 191501 - RNA, 1701 nt, Artificial Sequence
  derived and/or modified sequence opt5 from hemagglutinin__InfluenzaA__AFG71996
augaagaccaucauugcccugagcuacaucuucugccucgugcugggccagaacuuucccgggaaugacaacuccacagcuacgcuuugucugggacaccaugccgucccuaauggcacccucguuaaaacaauuaccaacgaucaaaucgaggugacaaaugcgaccgaacuggugcagucuagcuccacagggaagauuugcaacaauccgcacagaauccuugacggaaucgauuguacccugauugacgcucuccugggcgauccccauugcgacggguuccagaacgagacgugggaucuguuugucgaacggucuaaagccuucagcaauuguuauccuuacgacgugcccgauuaugccucccuccgcucucugguugcuagcuccggaacccuugaguuuaucaacgaaggcuucacauggaccggcgugacacagaaugggggaagcaacgccugcaagagaggcccugacauuggguuuuucucucggcugaauuggcucuacaaauccggaaacaccuaucccguccugaaugugagcaugccuaacaacgauaauuuugacaaacuuuacaucuggggcguucaccauccgucuacggaucaagagcagacaucccuguaugugcaggcuagcgggcgcgucaccgugucuacaaagagaucccagcaaaccauuauccccaacauuggaagccggccuugggugcgcggccucuccucuagaaucagcaucuacuggaccauugucaagcccggcgacauccugguuauuaauuccaacgggaaucugaucgccccucggggauacuucaagaugcgcacaggcaaaagcucuauuaugagauccgacgcgagcaucgggacguguaucucugagugcauuacccccaacggaagcaucccgaaugauaagccuuuucagaacgugaauaaaauuacauauggcgccugucccaaguacgugaagcagaacacccucaaacuggcuacagggaugcggaaugucccugaaaagcagacccgcggaaucuucggcgccauugcuggcuuuaucgagaacgggugggaaggaaugaucgacggcugguauggguucagacaccaaaauuccgagggaacgggccaggccgcggaucuuaaaucuacacaggccgcuauugaccaaaucaacgggaagcugaaucggauuaucgagaaaaccaacgaaaaguuccaccagauugagaaagaauuuagcgagguggaaggccgcauccaggaucucgagaaguacguugaggacaccaagauugaucugugguccuauaacgccgaacuucugguggcucucgagaaucagcauacaaucgaccugaccgauagcgaaaugaacaaacuguucgagaagacaagacggcaacucagagaaaaugccgaggacaugggaaacggcugcuuuaaaaucuaccacaagugugauaaugccugcauugggucuauccgcaacggaacguaugaccaugacgucuaccgggaugaggcucugaauaacagauuccagauuaaaggcguggaacuuaaguccggguacaaggacuggauccuguggauuagcuuugcgaucucuugcuuccuccuguguguugugcuucugggauuuaucaugugggccugccagaaaggcaauauucgcuguaacaucugcauuuga

SEQ ID NO: 191502 - RNA, 1701 nt, Artificial Sequence
  derived and/or modified sequence opt5 from hemagglutinin__InfluenzaA__AFG72007
augaagaccaucauugcccugagcuacaucuucugccucgugcugggcagagacuuuccccggaacgauaauuccacagcuacgcuuugucuggggcaccaugccgucccuaacggaacccucguuaaaacaauuaccaaugaccagaucgaggugacaaacgcgaccgaacuggugcaaucuagcuccacaggcaagauuugcaauaacccgcaccgcauccuugaugggauggacuguacccugaucgaugcucuccugggagacccccauugcgauggccugcagaaugggacgugggaccucuucgucgagagaucuaaagccuuuagcaacuguuauccuuacgaugugcccgacuaugccucccugcggucucuuguugcuagcuccggaacccuggaguucauuaaugaaggcuuuacauggaccggcgugacacagaacgggggaagcaaugccugcaagcgcggcccugauucuggguucuuuuccagacucaacuggcuguacaaaagcggaaauaccuaucccguccuuaacgugacgaugccuaauaacgacaacuucgauaagcuguacaucuggggcguucaccauccgucuacagaccaggaccaaaccucccucuaugugcaggcuagcgggcgggucacagugucuaccaagcgcucccagcagaccgugauucccaauaucggaccuagacccuggguccggggccugagcucccgcauuucuaucuacuggacaauuguuaaaccuggcgauauccugcucaucaacagcaaugggaaccugauugcccccagaggauacuuuaagaugcggacgggcaaauccagcaucaugcgcucugacgcgccgauugggaccuguaucuccgaaugcauuacaccuaauggaagcauccccaacgauaagccuuuccaaaaugugaacaaaaucaccuauggcgccugucccaaguacgugaagcagaauacacuuaaacuggcuaccgggaugagaaacguccccgagaagcagacgcggggaauuuuuggcgccaucgcuggcuucauugagaaugggugggaaggaaugaucgacggcugguauggguuucgccaccagaacucugagggaacaggccaagccgcggaucucaaaagcacccaggccgcuauugaccagaucaaugggaagcugaacagagugaucgagaaaaccaaugaaaaguuccaccaaauugagaaagaguucuccgaaguugaaggccggauccaggaucuugagaaguacguggaagacacaaagauugaucuguggucuuauaacgccgagcuccuggucgcucuggagaaccagcauaccaucgaccucacagauagcgaaaugaauaaacuguuugagaagacgagacgccagcuucgggaaaacgccgaggacaugggaaauggcugcuucaaaauuuaccacagaugugacaacgccugcaucggguccauucgcaauggaaccuaugaucaugacguguaccgggaugaagcucugaacaauagauuucaaaucaagggcguugagcucaaaagcggguacaaggacuggauccuguggauuucuuucgcgaucuccugcuuucuucugugugugguccuccugggauucauuaugugggccugccagaagggcaacauccgcuguaauauuugcaucuga

SEQ ID NO: 191503 - RNA, 1701 nt, Artificial Sequence
  derived and/or modified sequence opt5 from hemagglutinin__InfluenzaA__AFG72029
augaagaccaucauugcccugagcuacaucuucugccucguguuuggccagaaccugcccgggaaugacaacuccacagcuacgcuuugucugggacaccaugccgucccuaauggcacccucguuaaaacaauuaccaacgaucaaaucgaggugacaaaugcgaccgaacuggugcagucuagcuccacagggagaauuugcgacucuccgcaccggauccuugauggaaagaacuguacccugaucgacgcucuccugggcgauccccauugcgacggguuccagaaugagaaaugggaucuguuugucgaacgcagcaaggccuucuccaacuguuauccuuacgacgugcccgauuaugccucucucagaagccugauugcuuccagcggaacgcuugaguuuaucaaugaaggcuucaacuggaccggcguuacacagucugggggauccuacgccugcaaacggggcagcgacaauuccuuuuucucucgccugaacuggcucuaugagagcgagucuaaguacccugugcugaaugucaccaugcccaacaaugggaacuuugauaaacuuuauauuuggggagugcaccauccuuccacagacaaggaacaaaccaaccuguacguuagagcuagcggccgggugacggucuccacaaagcgcucucagcagaccaucauuccgaauaucgggagcagacccugggugcggggacucuccagccgcauuucuaucuacuggacaaucgugaaaccuggcgauauucugcugaucaacuccaauggcaaccucauugcccccagaggguauuucaagauccggaccggaaaaagcucuauuaugcgcagcgacgcgccuaucggcaccuguuccucugagugcaucacacccaaugggagcauuccgaacgacaagccuuuucagaaugucaacaagaucacguacggagccugucccaaauauguuaagcaaaauacccugaaacuugcuacaggcaugagaaacgugccugaaaagcagacccgggggauuuucggagccaucgcuggcuuuauugagaauggcugggaggggaugguggauggaugguacggcuuccgccaccagaacuccgaagggacaggacaggccgcggaccugaaaagcacccaagccgcuaucgaucagaucaauggcaagcucaacagagucauugagaaaacgaaugaaaaguuccaccagaucgagaaggaauuuucugagguggaggggcggauucaagaccuggaaaaauauguugaggauacaaagaucgaccuuugguccuacaacgccgaacugcucguggcucuggagaaccagcauaccauugaucugaccgacagcgaaaugaauaaacucuucgagaagacaagacgccagcugcgggagaacgccgaagauaugggcaauggaugcuuuaaaaucuaucacaagugugacaacgccugcauuggcucuaucagaaaugggaccuacgaucaugacgucuaccgcgacgaggcucuuaacaaucgguuccagaucaagggaguggaacugaaauccggcuauaaggauuggauucucuggaucagcuuugcgauuuccugcuuccugcuuuguguugugcugcucggguuuaucaugugggccugccaaaaaggaaacauuagauguaauaucugcaucuga

SEQ ID NO: 191504 - RNA, 1701 nt, Artificial Sequence
  derived and/or modified sequence opt5 from hemagglutinin__InfluenzaA__AFG72040
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccuggucgacgcccuccugggagauccccauugcgacggcuuccagaaugagaaaugggaucuguuuguggaacgcagcaaggccuucuccaacuguuauccuuacgacguucccgauuaugcuucucucagaagccugguggccuccagcgggacgcuugaguuuaucaaugaaucuuucaacuggaccggagucacacaguccggcggcagcuacgcuugcaaacgggggucugacaauuccuuuuucagccgccugaacuggcucuaugagucugaguccaaguacccugugcugaauguuaccaugcccaacaauggaaacuuugauaaacuuuauauuuggggcgugcaccauccuagcacagacaaggaacaaaccaaccuguacgucagagccuccgggcgggugacggugucuacaaagcgcagccagcagaccaucauuccgaauaucggauccagacccuggguccggggccucagcucucgcauuuccaucuacuggacaauuguuaaaccuggggauauccugcugaucaacagcaauggaaaccucauugcgcccagaggcuauuucaagauccggaccggcaaaucuagcauuaugcgcuccgacgccccuaucgggaccuguucuagcgagugcauuacacccaauggauccaucccgaacgacaagccuuuucagaaugugaacaagaucacguacggcgcuugucccaaauaugugaagcaaaauacccugaaacuugccacagggaugagaaacgucccugaaaagcagacccggggaauuuucggcgcuaucgccggguuuauugagaauggaugggagggcaugguggauggcugguacggguuccgccaccagaacagcgaaggaacaggccaggcggccgaccugaaaucuacccaagcugccaucgaucagauuaaugggaagcucaacagaguuaucgagaaaacgaaugaaaaguuccaccagaucgagaaggaauuuuccgagguggagggacggauucaagaccuggaaaaauaugucgagaacacaaagaucgaucuuuggagcuacaacgcugaacugcucguggcccuggagaaucagcauaccauugaccugaccgauucugaaaugaacaaacucuucgagaagacaagacgccagcugcgggagaaugccgaagacaugggcaacgggugcuuuaaaaucuaucacaagugugauaaugcuugcauuggcuccaucagaaacggaaccuacgaccaugauguuuaccgcgacgaggcgcuuaauaaccgguuccagauuaagggcguggaacugaaaagcggguauaaggacuggauccucuggaucuccuuugccauuucuugcuuccugcuuugugucgugcugcucggauuuaucaugugggcuugccaaaaaggcaauauuagauguaacaucugcauuuga

SEQ ID NO: 191505 - RNA, 1701 nt, Artificial Sequence
  derived and/or modified sequence opt5 from hemagglutinin__InfluenzaA__AFG72051
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccuggucgacgcccuccugggagauccccauugcgacggcuuccagaaugagaaaugggaucuguuuguggaacgcagcaaggccuucuccaacuguuauccuuacgacguucccgauuaugcuucucucagaagccugguggccuccagcgggacgcuugaguuuaucaaugaaucuuucaacuggaccggagucacacaguccggcggcagcuacgcuugcaaacgggggucugacaauuccuuuuucagccgccugaacuggcucuaugagucugaguccaaguacccugugcugaauguuaccaugcccaacaauggaaacuuugauaaacuuuauauuuggggcgugcaccauccuagcacagacaaggaacaaaccaaccuguacgucagagccuccgggcgggugacggugucuacaaagcgcaaucagcagaccgucaucccgaacauuggaagcagacccuggguucggggccucuccagccgcaucucuauuuacuggacaaucgugaaaccuggggauauucugcugaucaauuccaacggaaaucucaucgcgcccagaggcuauuucaagauucacaacggcaaaagcucuaucaugcggagcgacgccccuauugggaccuguuccucugagugcaucacccccaauggaagcauuccgaacgacaagccuuuucagaaugugaacaagaucacauacggcgcuugucccaaauaugucaagcaaaauacgcugaaacuugccaccgggaugcgcaacgugccugaaaagcagacaagaggaaucuucggcgcuauugccggguuuaucgagaauggaugggagggcaugguugauggcugguacggguuccggcaccgcaacuccgaaggaaccggccaggcggccgaccugaaaagcacacaggcugccauugaucaaaucaaugggaagcucaacagagugauugagaaaaccaacgaaaaguuccaucagaucgagaaggaauuuucugaggucgagggacggauccaggaccuggaaaaauauguggaggauacgaagauugaccuuugguccuacaaugcugaacugcucguugcccuggagaaccaacacacaaucgaucugaccgacagcgaaaugaauaaacucuucgagaagaccagacgccagcugcgggagaacgccgaagauaugggcaaugggugcuuuaaaauuuaucauaagugugacaacgcuugcaucggcucuauuagaaauggaacauacgaucacgacguguaccgcgacgaggcgcuuaacaaucgguuccagaucaagggcgucgaacugaaauccggguauaaggauuggauucucuggaucagcuuugccaucuccugcuuccugcuuugugugguccugcucggauuuauuaugugggcuugccagaaaggcaacaucagauguaauauuugcaucuga

SEQ ID NO: 191506 - RNA, 1701 nt, Artificial Sequence
  derived and/or modified sequence opt5 from hemagglutinin__InfluenzaA__AFG72085
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaucggagugacccagucuggcggcuccugcgcuuguaagcgggggagcgucaacucuuucuuuucccgccugaauuggcuccacgagagcgagcaaaaguauccugcccugaacgugacaaugcccaauaacggaaaauucgauaaacuuuacauuuggggcguucaucacccuucuaccgacagagaacagacaaaucuguaugugcgggcguccgggcgcgucaccgugagcacgaagagaucccagcagacagugaucccgaacauuggaucucggcccuggguccgcggccucagcuccagaaucagcauuuacuggaccaucguuaagccuggggauauccugcugauuaacucuaucggaaaucucauugcuccccggggcuacuuuaaaauccgcacaggcaaguccagcauuaugagaucugacgccccuaucgggaccugcagcuccgaguguaucacccccaacggaucuauuccgaaugacaagccuuuccaaaacgugaauaaaaucacauauggcgccugcccccgguacgugaagcagaacacgcugaaacuugcuaccgggaugcgcaaugucccugaaaagcagacaagaggaauuuuuggcgccaucgcgggguucauugagaacggaugggagggcaugguggauggcugguauggguuucggcaccagaauagcgaaggaaccggccaagccgcugaccugaaauccacacaggccgcuaucgaucagaucaacgggaagcucaauagacugauugagaaaaccaacgaaaaguuccaucaaaucgagaaggaguucagcgaaguugagggacgcauucaggaccuugaaaaauacguggaggauacgaagaucgaccuguggucuuauaaugccgaacuccuggucgcccuggagaaccagcacacaauugaucucaccgacuccgaaaugaauaaacuguuugagaagacccggaaacagcuuagagagaacgcugaagauaugggcaacggguguuucaagaucuaccauaagugcgacaaugcgugcauuggcagcauccgcaacggaacauaugaucacgacguguaccgggacgaggcccugaauaacagauuucaaaucaaaggcguugaacucaagucuggguacaaagauuggauucuguggaucuccuucgcuauuagcuguuuucuucugugcgugguccuccugggauucaucaugugggccugucagaagggcaauauucgcugcaacaucuguaucuga

SEQ ID NO: 191507 - RNA, 1701 nt, Artificial Sequence
  derived and/or modified sequence opt5 from hemagglutinin__InfluenzaA__AFG72107
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugauugccuccagcgggacgcuugaguuuaucaacgaagaguucaauuggaccggaguuacacagaacggcggcucuuacgcuugcaagcggggguccgugaauagcuuuuucucucgccugaacuggcuccacgaguccgaauauaaguacccugcccugaaugucaccaugcccaacaauggaagauuugacaaacuuuauauuuggggcgugcaucacccuagcacagaucgggagcaaaccaaccuguacguucgcgcgucugggagagugacggucuccacaaagcggagccagcagaccgugaucccgaacauuggaccccgcccuugggugagaggccucuccucucggaucagcauuuacuggacaaucgucaaacccggggacauccugcugauuaauuccaccggaaaccucaucgccccucgcggcuauuucaagauucacaccggcaaaagcucuaucaugagauccgaugcucccauugggacauguagcucugaaugcaucacgccgaauggaagcaucccuaacgacaagcccuuucagaauguuaacaagauuaccuacggcgccuguccucgguaugugaaacaaaauacacugaaacuugcuaccgggaugcgcaacgugcccgagaagcagacaagaggaaucuucggcgccauugcgggguuuaucgagaauggaugggaaggcauggucgacggcugguacggguuccggcaucagaacuccgagggaaccggccaggccgcugaucugaagucuacgcaagccgcuauugaccagaucaaugggaaacucaacagacugaucgaaaagacaaaugagaaauuccaccagauugaaaaggaguuuagcgagguggaaggacgcauccaagaucuugagaaguauguugaagacaccaaaauugaucugugguccuacaacgccgagcuccugguggcccuggaaaaucagcauaccaucgaccucacagauagcgagaugaacaagcuguucgagaaaacccggaagcagcuuagagaaaacgcugaggacaugggcaaugggugcuuuaaaauuuaucacaagugugauaacgcgugcaucggcucuauucgcaauggaacauacgaccacgaugucuaccgggacgaagccgugaacaauagauuccagaucaagggcguugagcugaaauccggguauaaggacuggauccucuggauuagcuuugcuaucucuugcuuccugcuuugugugauucugcucggauuuaucaugugggccugccaaaaaggcaacauucgcuguaauaucugcaucuga

SEQ ID NO: 191508 - RNA, 1701 nt, Artificial Sequence
  derived and/or modified sequence opt5 from hemagglutinin__InfluenzaA__AFG72118
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcaaaauucuagcacaggcagaauuugcaacuccccgcaccggauccuugacgggaaaaauuguacccugaucgaugcccuccugggagacccccauugcgauggcuuccagaacaaggagugggaccuguuugucgaacgcucuaaagccuauagcaauuguuacccuuaugaugugcccgacuacgcuucccucagaucucugguugccagcuccgggacgcuugaguucauuaacgaagauuuuaauuggaccggaguggcucagagcggcggcucuuaugccugcaagcggggguccgucaacagcuucuuuucucgccugaauuggcuccacgaguccgaguacaaguauccugcgcugaacgugacaaugcccaauaacggaaaauucgacaaacuuuacaucuggggcguucaucacccuagcaccgauagagaacagacaaaccuguacgugcgggccucugggcgcgucaccguguccacgaagagaagccagcagacagugauuccgaauaucggaucccggcccuggguccgcggccucucuagcagaauuuccaucuauuggaccauuguuaagccuggggacauccugcugaucaacagcacaggaaaucucauugcuccccggggcuacuuuaaaauccgcaccggcaagucuuccauuaugagaagcgaugccccuaucgggaccuguucuagcgagugcauuacacccaacggauccaucccgaaugacaagccuuuccagaacgugaaucggaucacguauggcgcuuguccccgcuacgugaaacaaaacacccugaagcuggccacagggaugagaaaugucccugaacggcagaccagaggaauuuuuggcgcgaucgccggguucauugagaacggaugggagggcaugguggacggcugguauggguuucgccaccaaaauucugaaggaacaggccaggcugccgaucuuaaaagcacccaggcugccaucgaccagauuaacgggaagcucaaucggcugaucgagaaaacgaacgaaaaguuccaucagaucgagaaagaguucuccgaaguugagggacgcauucaagaucuugaaaaguacguggaggacacaaagaucgaucuguggagcuauaaugccgaacuccuggucgcucuggagaaccagcacaccauugaccucaccgauucugaaaugaacaaacuguuugagaagacaagaaaacagcuucgggagaaugcggaagacaugggcaacgggugcuucaagaucuaccauaaaugugauaaugccugcauuggcuccaucagaaacggaaccuacaaucacgacguguaucgcgaugaggcucugaacaaucgguuucagauuaagggcguugaacucaagagcggguacaaagacuggauccuguggaucucuuucgccauuuccugcuuucuucugugugugguccuccugggauucaucaugugggccugccaaaagggcaacauuagauguaauaucugcauuuga

SEQ ID NO: 191509 - RNA, 1701 nt, Artificial Sequence
  derived and/or modified sequence opt5 from hemagglutinin__InfluenzaA__AFG72129
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggccuccgggcgcgucaccgugagcacgaagagaucccagcagacagugauuccgaacaucggaucucggcccuggguccgcggccucagcuccgggauuagcaucuauuggaccauuguuaagccuggagauauccugcugaucaacucuacaggcaaucucauugcucccagaggcuacuuuaaaauccggaccgggaaguccagcauuaugcgcucugacgccccuaucggaaccuguagcuccgagugcauuacacccaacggcucuaucccgaaugacaagccuuuccagaacgugaauagaaucacguauggggcuuguccccgguacgugaaacaaaacacccugaaacuugccacaggaaugcgcaaugucccugaaaagcagaccagaggcauuuuuggggcgaucgccggauucauugagaacggcugggagggcaugguggaugggugguauggauuucggcaccagaauagcgaaggcacagggcaggcugccgaccugaaguccacccaagcugccaucaaccagauuaauggaaaacucaacagacugaucgagaagacgaaugaaaaauuccaucagaucgagaaggaguucagcgaaguugagggccgcauucaagaucuugaaaaguacguggaggacacaaaaaucgaucuguggucuuauaacgccgaacuccuggucgcucuggagaaucagcacaccauugaccucaccgauuccgaaaugaacaagcuguuugagaaaacacggaagcagcuuagagagaacgcggaagacauggggaauggcugcuucaaaaucuaccauaagugugauaacgccugcauuggaagcauccgcaauggcaccuacgaccacgauguguaucgggacgaggcucugaacaauagauuucagauuaaggggguugaacucaaaucuggauacaaggacuggauccuguggaucuccuucgccauuagcugcuuucuucugugugugguccuccugggcuucaucaugugggccugccaaaaagggaacauucgcuguaauaucugcauuuga

SEQ ID NO: 191510 - RNA, 1701 nt, Artificial Sequence
  derived and/or modified sequence opt5 from hemagglutinin__InfluenzaA__AFG72140
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggcccucgggcgcgucaccguguccacgaagagaagccagcagacagugauuccgaacaucggaucccggcccuggguccgcggccugucuagcagaauuuccaucuauuggaccauuguuaagccuggggauauccugcucaucaacagcacaggaaaucugauugcuccccggggcuacuuuaaaauccgcaccggcaagucuuccauuaugagaagcgacgccccuaucgggaccuguucuagcgagugcauuacacccaacggauccaucccgaauaacaagccuuuccagaaugugaaccggaucacguauggcgcuuguccccgcuacgugaaacaaaauacccuuaagcuggccacagggaugagaaacgucccugaaaaacagacccggggaauuuuuggcgcgaucgccggguucauugagaauggaugggagggcaugguggacggcugguauggguuuagacaccagaacucugaaggaacaggccaggcugccgaucucaagagcacccaagcugccaucgaccagauuaaugggaaacugaaccgccuuaucgagaagacgaaugaaaaauuccaucagaucgagaaggaguucuccgaaguugagggacggauucaagaucuggaaaaguacguggaggacacaaaaaucgaucucuggagcuauaacgccgaacugcuggucgcucucgagaaucagcacaccauugaccugaccgauucugaaaugaacaaacuuuuugagaagacaagaaagcagcugcgcgagaacgcggaagacaugggcaaugggugcuucaaaaucuaccauaagugugauaacgccugcauuggcuccauccggaauggaaccuacgaccacgauguguauagagacgaggcucucaacaaucgcuuucagauuaagggcguugaacugaaaagcggguacaaggacuggauccuuuggaucucuuucgccauuuccugcuuucugcucugugugguccugcugggauucaucaugugggccugccaaaaaggcaacauucgguguaauaucugcauuuga

SEQ ID NO: 191511 - RNA, 1701 nt, Artificial Sequence
  derived and/or modified sequence opt5 from hemagglutinin__InfluenzaA__AFG72151
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaagacuucaauuggacaggaguggcucagucuggcgaguccuaugccugcaagcggggcagcgucaagucuuucuucucccgccucaacuggcugcacgagagcgauuacaaauauccugcgcuuaaugugaccaugcccaacaaugggaaguuugacaaacuguacauuuggggaguucaucacccuucuacagauagagaacaaaccucccucuacgugcgggccagcggccgcgucacgguguccacaaagagaucucagcagaccgugaucccgaacauugggagccggcccuggguccgcggacuguccagcagaaucucuauuuauuggacaaucguuaaaccuggcgacauucugcucaucaauuccaccgggaaccugaucgcuccccggggauacuucaagauucgcaccggcaagagcucuaucaugagaagcgacgccccuauuggcacauguuccucugagugcaucacgcccaacgggagcauuccgaaugauaaaccuuuucagaacgugaaucggaucaccuauggagcuuguccccgcuacgugaagcaaaacacacuuaaacuggccaccggcaugagaaaugucccugaaaagcagacacgggggaucuucggagcgauugccggcuuuaucgagaacgggugggagggaaugguggacggcugguauggcuucagacaccaaaauuccgaagggaccggacaggcugccgaucucaaaagcacgcaggcugccauugaccagaucaacggcaagcugaaucgccuuauugagaaaacaaacgaaaaguuucaucagaucgagaaggaauuuucugagguugaggggcggauccaagaucuggaaaaauacguggaggacaccaagauugaucucugguccuauaaugccgaacugcuggucgcucucgagaaccagcacaccaucgaccugacagauagcgaaaugaauaaacuuuucgagaagaccagaaaacagcugcgcgagaacgcggaagacaugggaaauggcugcuuuaagauuuaccauaagugugauaacgccugcaucgggucuauucggaacggcacauacgaccacgacguguauagagaugaggcucucaauaaccgcuuccagaucaaaggaguugaacugaaguccggcuacaaagacuggauucuuuggaucagcuuugccaucuccugcuuccugcucugugugguccugcugggguuuauuaugugggccugccaaaagggaaauauccgguguaacauuugcaucuga

SEQ ID NO: 191512 - RNA, 1701 nt, Artificial Sequence
  derived and/or modified sequence opt5 from hemagglutinin__InfluenzaA__AFG72184
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacgauuuucagaacaaggagugggaccucuucgucgaacgcagcaaagccuauuccaauuguuacccuuaugaugugcccgacuacgcuucucugagaagccuuguugccuccagcggcacgcuggaguuuauuaacgaagauuucaauuggaccgggguggcucagucuggagaguccuaugccugcaagcggggcagcgucaagagcuuuuucucccgccucaacuggcugcacgagagcgaauacaaauauccugcgcuuaaugugacaaugcccaacaaugacaaguuugauaaacuguacaucuggggcguucaucacccuucuaccgagagagaacaaacaucccucuacauucgggccagcgggcgcgugaccgucuccacgaagagaucucagcagacagugaucccgaacauuggaagccggcccugggugcgcggccuguccagcagaaucucuauuuauuggaccaucgucaaaccuggggacauccugcucauuaauuccacaggaaaccugaucgcuccccggggcuacuucaagauucgcaccgggaagucuucuaucaugagaagcgacgccccuauuggaaccuguuccucugagugcaucacacccaacggcagcaucccgaaugauaaaccuuuucagaacguuaaucggauuacguauggcgcuuguccccgcuacgugaagcaaaacacccuuaaacuggccacagggaugagaaaugugccugagaagcagacccggggaaucuucggcgcgauugccggguuuaucgaaaacggaugggagggcauggucgacgggugguauggauucagacaccaaaauuccgaaggcacaggccaggcugccgaucucaaaagcacccaggcugccauugaccagaucaacgggaagcugaaucgccuuaucgagaaaacgaacgaaaaguuucaucagauugagaaggaguucucugaaguggagggacggauccaagaucuggaaaaauacguugaggacacaaagauugaucucugguccuauaaugccgaacugcugguggcucucgagaaccagcacaccaucgaccugaccgauagcgagaugaauaaacuuuucgaaaagacaagaaaacagcugcgcgagaacgcggaagacaugggcaaugggugcuuuaagauuuaccauaagugugauaacgccugcaucggaucuauucggaacggcaccuacgaccacgacgucuauagagaugaggcucucaauaaccgcuuccagaucaaagggguggaacugaaguccggcuacaaagacuggauccuuuggauuagcuuugccaucuccugcuuccugcucuguguugugcugcugggauuuauuaugugggccugccaaaagggcaauauccgguguaacauuugcaucuga

SEQ ID NO: 191513 - RNA, 1701 nt, Artificial Sequence; identical to SEQ ID NO: 191511
  derived and/or modified sequence opt5 from hemagglutinin__InfluenzaA__AFG72195

SEQ ID NO: 191514 - RNA, 1701 nt, Artificial Sequence
  derived and/or modified sequence opt5 from hemagglutinin__InfluenzaA__AFG72206
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcacagaauccuggaugggaagaauuguacccucaucgacgcccugcugggagauccccauugcgacggcuuucagaacaaagagugggaucucuucgucgaacggagcaaggccuauuccaauuguuacccuuaugacgugcccgauuacgcuucucugcgcagccuuguugccuccagcgggacgcuggaguuuauuaacgaagacuucaauuggaccggaguggcucagucuggcgaguccuaugccugcaagagaggcagcgucaaaucuuucuucucccggcucaacuggcugcacgagagcgauuacaaguauccugcgcuuaaugugacaaugcccaacaaugggaaauuugacaagcuguacaucuggggaguucaucacccuucuaccgaucgcgaacaaacaucccucuacauuagagccagcggccgggugaccgucuccacgaaacgcucucagcagacagugaucccgaacauugggagcagacccugggugcggggacuguccagccgcaucucuauuuauuggaccaucgucaagccuggcgacauccugcucauuaauuccacagggaaccugaucgcucccagaggauacuucaagauucggaccggcaaaagcucuaucaugcgcagcgacgccccuauuggcaccuguuccucugagugcaucacacccaacgggagcaucccgaaugauaagccuuuucagaacguuaauagaauuacguauggagcuuguccccgguacgugaaacaaaacacccuuaagcuggccacaggcaugcgcaaugugccugaaaaacagaccagagggaucuucggagcgauugccggcuuuaucgagaacgggugggagggaauggucgacggcugguauggcuuccggcaccaaaauuccgaagggacaggacaggcugccgaucucaagagcacccaggcugccauugaccagaucaacggcaaacugaauagacuuaucgagaagacgaacgaaaaguuucaucagauugagaaagaauuuucugagguggaggggcgcauccaagaucuggaaaaguacguugaggacacaaaaauugaucucugguccuauaaugccgaacugcugguggcucucgagaaccagcacaccaucgaccugaccgauagcgaaaugaauaaacuuuucgagaagacacggaagcagcugagagagaacgcggaagacaugggaaauggcugcuuuaagauuuaccauaaaugugauaacgccugcaucgggucuauucgcaacggcaccuacgaccacgacgucuaucgggaugaggcucucaauaacagauuccagaucaagggaguggaacugaaauccggcuacaaggacuggauccuuuggauuagcuuugccaucuccugcuuccugcucuguguugugcugcugggguuuauuaugugggccugccaaaaaggaaauauccgcuguaacauuugcaucuga

SEQ ID NO: 191515 - RNA, 1701 nt, Artificial Sequence
  derived and/or modified sequence opt5 from hemagglutinin__InfluenzaA__AFG72217
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugaccccgaauauuggaucuagacccuggguccggggccugagcucccgcaucagcauuuauuggacaaucguuaaaccuggggacauucuccugaucucuuccaccggaaaccuuaucgcucccagaggcuacuucaagauucggaacggcaagagcucuaucaugcgcagcgaugccccuauugggaauuguuccucugagugcaucacccccaacggaagcauuccgaaugacaaaccuuuucagaacgugaauagaaucacauauggcgcuuguccccgguacgugaagcaaaacacgcugaaacucgccaccgggaugcgcaaugucccugaaaagcagacaagaggaaucuucggcgcgauugccggguuuaucgagaacggaugggaaggcaugguggauggcugguauggguuccggcaccaaaauuccgagggaaccggccaggcugccgacauuaaaagcacacaggcugccaucgaucagauuaacgggaagcugaauagacuuaucgagaaaaccaacgaaaaguuucaucagaucgagaaggaguucucugaaguugaaggacgcauucaagaccuggagaaauacguggaggauacgaagaucgaccucugguccuauaaugccgaacugcuggucgcucucgagaaccagcacacaauugaucugaccgacagcgaaaugaauaaacuuuucgagaagacccggaaacagcugagagaaaacgcggaggauaugggcaacgggugcuuuaagaucuaccauaagugugacaaugccugcauuggcucuauccgcaacggaacauacgaccacgauguguaucgggacgaggcucucaauaacagauuccagauuaaaggcguugaacugaaguccggguacaaagaucuuauccuguggaucagcuuugccauuuccugcuuccuccugugugugguccugcucggauuuaucaugugggccugccaaaagggcaauauucgcuguaacaucugcauuuga

SEQ ID NO: 191516 - RNA, 1701 nt, Artificial Sequence
  derived and/or modified sequence opt5 from hemagglutinin__InfluenzaA__AFG72228
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaagacuucaauuggacaggaguggcucagucuggcgaguccuaugccugcaagcggggcagcgucaaguccuuuuucucucgccucaacuggcugcacgagagcgauuacaaauauccugaacuuaaugugaccaugcccaacaaugggaaguuugacaaacuguacauuuggggaguucaucacccuucuacagauagagagcaaaccucccucuacgugcgggcgagcggccgcgucacgguguccacaaagagaucucagcagaccgugaucccgaacauugggagccggcccuggguccgcggacuguccagcagaaucucuauuuauuggacaaucguuaaaccuggcgacauucugcucaucaauuccaccgggaaccugaucgcuccccggggauacuucaagauucgcaccggcaagagcucuaucaugagaagcgacgccccuauuggcacauguuccucugaaugcaucacgcccaacgggagcauuccgaaugauaaaccuuuucagaacgugaaucggaucaccuauggagccuguccccgcuacgugaagcaaaacacacuuaaacuggcuaccggcaugagaaaugucccugagaagcagacacgggggaucuucggagccauugcgggcuuuaucgagaacgggugggaaggaaugguggacggcugguauggcuucagacaccaaaauuccgaggggaccggacaggccgcugaucucaaaagcacgcaggccgcuauugaccagaucaacggcaagcugaaucgccuuauugagaaaacaaacgaaaaguuucaucagaucgaaaaggaguucucugagguugaagggcggauccaagaucuggagaaauacguggaagacaccaagauugaucucugguccuauaaugccgagcugcuggucgcccucgaaaaccagcacaccaucgaccugacagauagcgagaugaauaaacuuuucgagaagaccagaaaacagcugcgcgaaaacgcugaggacaugggaaauggcugcuuuaagauuuaccauaagugugauaacgcgugcaucgggucuauucggaacggcacauacgaccacgacguguauagagaugaagcccucaauaaccgcuuccagaucaaaggaguugagcugaaguccggcuacaaagacuggauucuuuggaucagcuuugcuaucuccugcuuccugcucugugugguccugcugggguuuauuaugugggccugccaaaagggaaauauccgguguaacauuugcaucuga

SEQ ID NO: 191517 - RNA, 1701 nt, Artificial Sequence
  derived and/or modified sequence opt5 from hemagglutinin__InfluenzaA__AFG72239
augaagaccaucauugcccugagcuacauccucugccuggugcuugcucagaaacugcccggcuccgacaacucuacagccacgcucugucuggggcaccaugcggucccuaauggaacccuuguuaagacaauuaccaacgaucaaaucgaggugacaaaugcuaccgaacuggugcagagcuccacaaccggcagaauuugcgacucuccgcaccggauccucgaugggaaaaacuguacgcugaucgacgcccugcucggagauccccauugcgacggcuuccagaauaaggagugggaucuguuugucgaacgcagcaaagccuauuccaacuguuacccuuaugacgugcccgauuacgcuucucuuagaagccugguugccuccagcgggacccucgaguucacaaaugaagacuuuaacuggaccggaguggcucagucuggcgaguccuaugccugcaagcggggcagcgucaagucuuucuuuucccgccugaauuggcuucacgagagcgauuacaaauauccugcgcugaacgugacaaugcccaauaacgggaaguucgacaaacucuacauuuggggaguucaucacccuucuaccgauagagaacaaacgucccuguacgugcgggccagcggccgcgucacaguguccaccaagagaucucagcagacagugaucccgaauauugggagccggcccuggguccgcggacuguccagcagaaucucuauuuauuggaccaucguuaaaccuggcgacauucuccugaucaacuccaccgggaaucuuaucgcuccccggggauacuuuaagauucgcacaggcaagagcucuaucaugagaagcgacgccccuauuggcacguguuccucugagugcaucacccccaacgggagcauuccgaacgauaaaccuuuccagaaugugaaccggaucacauauggagcuuguccccgcuacgugaagcaaaauacccugaaacucgccacaggcaugagaaacgucccugaaaagcagacccgggggaucuuuggagcgauugccggcuucaucgagaaugggugggagggaaugguggacggcugguauggcuuuagacaccagaacuccgaagggacgggacaggcugccgaucugaaaagcacacaagcugccauugaccagaucaauggcaaacuuaaccgccugauugagaagaccaaugaaaaguuccaucagaucgagaaggaauuuucugagguugaggggcggauccaagaucucgaaaaauacguggaggacaccaagauugaucugugguccuauaacgccgaacugcucgucgcucuggagaaucagcacacaaucgaccuuaccgauagcgaaaugaacaaacuguucgagaagacaagaaaacagcuccgcgagaaugcggaagacaugggaaacggcugcuucaagauuuaccauaagugugauaaugccugcaucgggucuauucggaacggcacguacgaccacgacguguauagagaugaggcucugaacaaucgcuuucagaucaaaggaguugaacuuaaguccggcuacaaagacuggauucuguggaucagcuucgccaucuccugcuuucuccugugugugguccugcucggguucauuaugugggccugccaaaagggaaacauccgguguaauauuugcaucuga

SEQ ID NO: 191518 - RNA, 1701 nt, Artificial Sequence; identical to SEQ ID NO: 191511
  derived and/or modified sequence opt5 from hemagglutinin__InfluenzaA__AFG72272

SEQ ID NO: 191519 - RNA, 1701 nt, Artificial Sequence
  derived and/or modified sequence opt5 from hemagglutinin__InfluenzaA__AFG72316
augaagaccaucauugcccugagccacauccucugccugguguucgcucagaaacuucccggcaacgacaauuccacagccacgcugugucucgggcaucacgcggucccuaacggaacccugguuaagacaauuaccaaugaucaaaucgaggugacaaacgcuaccgaacuugugcagucuagcuccacaggcagaauuugcgacucuccgcaucggauccuggaugggaaaaauuguacccucaucgacgcccugcugggagauccccacugcgacggcuuucagaacaaggagugggaucucuucgucgaacgcagcaaagccuacuccaauuguuauccuuacgacgugcccgauuaugcuucucugagaagccuuguugccuccagcgggacgcuggaguuuauuaacgaagacuucaauuggaccggaguggcucaggauggcggcucuuacgccugcaagcggggguccgucaacagcuuuuucucucgccucaauuggcugcauaaacuugaguauaaguacccugcgcugaacgugacaaugcccaauaacggaaaguuugacaaacucuauaucuggggcguucaccacccuuccaccgauagcgaccaaacaucucuguacgugagagccuccgggcgggucaccgugagcacgaagcgcucccagcagacagugaccccgaauauuggaucuagacccuggguccggggccugagcucccgcaucagcauuuacuggacaaucguuaaaccuggggacauucuccugaucaacucuaccggaaaccuuaucgcucccagaggcuauuucaagauucggaauggcaaguccagcaucaugcgcucugaugugccuauugggaacuguagcuccgagugcaucacccccaauggaucuauuccgaacgacaaaccuuuucagaaugugaacagaaucacauacggcgccuguccccgguaugucaagcaaaauacgcugaaacucgcuaccgggaugcgcaacgugccugaaaagcagacaagaggaaucuucggcgccauugcgggguuuaucgagaauggaugggaaggcaugguugauggcugguacggguuccggcaucagaacagcgagggaaccggccaggccgcugaccugaaauccacacaagccgcuauugaucagaucaaugggaaacuuaacagacugauugagaagaccaaugaaaaguuucaccagaucgagaaggaguucagcgaaguggaaggacgcauccaagaccucgagaaauaugucgaggauacgaagauugaccuguggucuuacaacgccgaacugcucguggcccuggagaaucagcauacaaucgaucuuaccgacuccgaaaugaacaaacuguucgagaagacccggaaacagcucagagaaaacgcugaggauaugggcaaugggugcuuuaagauuuaucacaagugugacaacgcgugcaucggcagcauucgcaauggaacauacgaccacgauguuuaccgggacgaggcccugaacaauagauuccagaucaaaggcguggaacuuaagucuggguauaaagauuggauucuguggaucuccuuugcuaucagcugcuuccuccugugugucgugcugcucggauuuauuaugugggccugccaaaagggcaacauccgcuguaauauuugcaucuga

SEQ ID NO: 191520 - RNA, 1701 nt, Artificial Sequence
  derived and/or modified sequence opt5 from hemagglutinin__InfluenzaA__AFG72339
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacguuucucugagaagccuuguggcuuccagcgggacgcuggaguuuauuaacgaagacuucaauuggaccggagucgcccaggauggcggcucuuauacaugcaagcggggguccgugaacagcuuuuucucucgccucaauuggcugcacaaguccgaguacaaauauccugcucuuaacguuaccaugcccaauaacggaaaguuugacaaacuguacaucuggggcgugcaucacccuagcacagauucugaccaaaccucccucuacgucagagccagcgggcgggugacgguguccacaaagcgcucucagcagaccgucacaccgaauauuggaagcagacccuggguucggggccuguccagccgcaucucuauuuauuggaccaucgugaaaccuggggacauucugcucaucaacuccaccggaaaccugaucgcgcccagaggcuacuucaagauucggaauggcaagagcucuaucaugcgcagcgaugccccuauugggacauguuccucugagugcaucacgcccaacggaagcauuccgaaugacaaaccuuuucagaacgugaauagaaucaccuauggcgcuuguccccgguacgucaagcaaaacacacuuaaacuggccaccgggaugcgcaaugugccugaaaagcagacaagaggaaucuucggcgcuauugccggguuuaucgagaacggaugggaaggcaugguugauggcugguauggguuccggcaccaaaauuccgagggaaccggccaggcggccgaccucaaaagcacgcaggcugccauugaucagaucaacgggaagcugaauagacuuauugagaaaacaaacgaaaaguuucaucagaucgagaaggaguucucugaaguggaaggacgcauccaagaccuggagaaauacgucgaggauaccaagauugaccucugguccuauaaugcugaacugcugguggcccucgagaaccagcacaccaucgaucugacagacagcgaaaugaauaaacuuuucgagaagacccggaaacagcugagagaaaacgccgaggauaugggcaacgggugcuuuaagauuuaccauaagugugacaaugcuugcaucggcucuauucgcaacggaacauacgaccacgauguuuaucgggacgaggcgcucaauaacagauuccagaucaaaggcguggaacugaaguccggguacaaagauuggauucuuuggaucagcuuugccaucuccugcuuccugcucugugucgugcugcugggauuuauuaugugggcuugccaaaagggcaauauccgcuguaacauuugcaucuga

SEQ ID NO: 191521 - RNA, 1701 nt, Artificial Sequence
  derived and/or modified sequence opt5 from hemagglutinin__InfluenzaA__AFG72350
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacguuucucugagaagccuuguggcuuccagcgggacgcuggaguuuauuaacgaagacuucaauuggaccggagucgcccaggauggccggucuuaugcuugcaagcgcggcuccgugaacagcuuuuucucuagacucaauuggcugcacaaguccgaguacaaauauccugcccuuaacguuacaaugcccaauaacgggaaguuugacaaacuguacaucuggggagugcaucacccuagcaccgauucugaccaaacaucccucuacguccgggcgagcggccgcgugaccguguccacgaagagaucucagcagacagucaccccgaauauugggagccggcccuggguucgcggacuguccagcagaaucucuauuuauuggacaaucgugaaaccuggcgacauucugcucaucaacuccaccgggaaccugaucgcuccccggggauacuucaagauucgcaauggcaagagcucuaucaugagaagcgaugccccuauuggcaucuguuccucugagugcauuacccccaacgggagcaucccgaaugacaaaccuuuucagaacgugaaucggaucacauauggagccuguccccgcuacgucaagcaaaacacgcuuaaacuggcuaccggcaugagaaaugugccugaaaagcagacacgggggauuuucggagccaucgcgggcuuuauugagaacgggugggaaggaaugguugauggcugguauggcuucagacaccaaaauuccgaggggaccggacaggccgcugaccucaaaagcacacaggccgcuaucgaucagauuaacggcaagcugaaucgccuuaucgagaaaaccaacgaaaaguuucaucagaucgagaaggaguucucugaaguggaagggcggauucaagaccuggagaaauacgucgaggauacgaagaucgaccucugguccuauaaugccgaacugcugguggcccucgagaaccagcacacaauugaucugaccgacagcgaaaugaauaaacuuuucgagaagaccagaaaacagcugcgcgaaaacgcugaggauaugggaaacggcugcuuuaagaucuaccauaagugugacaaugcgugcauugggucuauccggaacggcacauacgaccacgauguuuauagagacgaggcccucaauaaccgcuuccagauuaaaggaguggaacugaaguccggcuacaaagauuggauccuuuggaucagcuuugcuauuuccugcuuccugcucugugucgugcugcugggguuuaucaugugggccugccaaaagggaaauauucgguguaacaucugcauuuga

SEQ ID NO: 191522 - RNA, 1701 nt, Artificial Sequence
  derived and/or modified sequence opt5 from hemagglutinin__InfluenzaA__AFG72372
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuauacaugcaagcggggcuccgucaacagcuuuuucucucgccucaauuggcugcacaaacuugaguacaaguauccugcccugaacgugaccaugcccaauaacgggaaauuugacaagcucuacaucuggggaguucaucacccuuccacagauagcgaccaaaccucucuguacgugagagcguccggccgggucacggugagcacaaaacgcucccagcagaccgugauuccgaauaucgggucuagacccuggguccggggacugagcucccgcauuagcaucuauuggacaauuguuaagccuggcgacauccuccugaucaacucuaccgggaaccuuauugcccccagaggauacuucaagauccggaauggcaaauccagcauuaugcgcucugaugcuccuaucggcaacuguagcuccgagugcauuacccccaaugggucuaucccgaacgacaagccuuuucagaaugugaacagaaucacauauggagccuguccccgguacgugaaacaaaauacgcugaagcucgcuaccggcaugcgcaacgucccugaaaaacagacaagagggauuuucggagccaucgcgggcuuuauugagaaugggugggaaggaaugguggauggcugguauggcuuccggcaccagaacagcgaggggaccggacaggccgcugaccugaaguccacacaagccgcuaucgaucagauuaauggcaaacuuaacagacugaucgagaagaccaaugaaaaguuucaucagaucgagaaagaguucagcgaaguugaagggcgcauucaagaccucgagaaguacguggaggauacgaaaaucgaccuguggucuuauaacgccgaacugcucgucgcccuggagaaucagcacacaauugaucuuaccgacuccgaaaugaacaagcuguucgagcggaccagaaaacagcuccgcgaaaacgcugaggauaugggaaauggcugcuuuaagaucuaccauaagugugacaacgcgugcauugggagcauccggaauggcacauacgaccacgauguguauagagacgaggcccugaacaaucgcuuccagauuaaaggaguugaacuuaagucuggcuacaaagauuggauccuguggaucuccuuugcuauuagcugcuuccuccugugugugguccugcucggguuuaucaugugggccugccaaaagggaaacauucgguguaauaucugcauuuga

SEQ ID NO: 191523 - RNA, 1701 nt, Artificial Sequence; identical to SEQ ID NO: 184048
  derived and/or modified sequence opt5 from hemagglutinin__InfluenzaA__AFG72383

SEQ ID NO: 191524 - RNA, 1701 nt, Artificial Sequence
  derived and/or modified sequence opt5 from hemagglutinin__InfluenzaA__AFG72394
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccguggcuacgaaacgcagccagcagacagugauuccgaauaucggguucagacccuggguccggggacaguccucuggcauuagcaucuauuggaccauuguuaagccuggggacauccugcucaucaacuccacaggaaaccugauugcccccagaggcuacuuuaagaucagaaauggcaaaagcucuauuaugcgguccgaugcuccuaucgggaacuguagcucugagugcauuacccccaauggaagcaucccgaacgacaagccuuuccaaaaugugaaccgcaucaccuauggcgccugucccagauacgugaaacagaauacacuuaagcuggcgacggggaugcggaacgucccugaaaaacagacccgcggaauuuuuggcgccaucgcuggguucauugagaauggaugggaaggcaugguggauggcugguauggguuuagacaccagaacuccgagggaacaggccaagccgcugaccucaagucuacccaggccgccaucgaucagauuaaugggaaacugaaccggcuuaucgagaagacaaaugaaaaguuccaucaaaucgagaaagaguucagcgaaguugaaggacgcauucaggaccuggagaaguacguggaggauaccaaaaucgaccucugguccuauaacgcuggccugcuggucgcgcucgaaaaucagcacacgauugaucugacagacagcgagaugaacaaacuuuuugaacgcacccggaagcagcugagagagaacgccgaagauauggggaauggcugcuucaagaucuaccauaagugugacaacgcuugcauuggaucuauccgcaauggcaccuacgaccacgauguguaucgggacgaggcccucaacaauagauuucaaauuaaagggguugagcugaaguccggauacaaagauuggauccuuuggaucagcuucgccauuucuugcuuucugcucugugugguccugcugggcuucaucaugugggcuugccagaaggggaacauucgcuguaauaucugcauuuga

SEQ ID NO: 191525 - RNA, 1701 nt, Artificial Sequence
  derived and/or modified sequence opt5 from hemagglutinin__InfluenzaA__AFG72405
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagaucccaacugcgacggcuuucagaauaaggagugggaucucuucgucgaacgcagcaaagccuauuccaacuguuacccuuaugacgugcccgauuacgcuucucugagaagccuuguugccuccagcgggacgcuggaguuuaccaaugaagacuucaacuggacaggaguggcucaggauggcggcucuuaugccugcaagcggggguccgucaagagcuuuuucucucgccucaauuggcugcauaaacuugaguacaaguauccugcgcugaacgugaccaugcccaauaacggaaaauuugacaagcucuacauuuggggcguucaccauccuuccacagauagcgaccaaaccucucuguacgugagagccuccgggcgggucacggugagcacaaaacgcucccagcagaccgugacaccgaauaucggaucuagacccuggguccggggccugagcucccgcauuagcaucuauuggaccauuguuaagccuggggacauccuccugauuaacucuaccggaaaccuuaucgcucccagaggcuacuucaagauccggaauggcaaauccagcauuaugcgcucugaugccccuaucgggacauguagcuccgagugcauuacgcccaacggaucuaucccgaaugacaagccuuuucagaacgugaauagaauuaccuauggcgcuuguccccgguacgugaaacaaaacacacugaagcucgccaccgggaugcgcaaugucccugaaaaacagacaagaggaaucuucggcgcgaucgccggguuuauugagaacggaugggaaggcaugguggauggcugguauggguuccggcaccagaauagcgagggaaccggccaggcugccgaccugaaguccacgcaagcugccaucaaccagauuaaugggaaacuuaacagacugaucgagaagacaaaugaaaaguuucaccagauugagaaagaguucagcgaaguugaaggacgcauccaagaucucgagaaguacguggaggacaccaaaaucgaucuguggucuuauaacgccgaacugcucgucgcucuggagaaucagcauaccauugaccuuacagauuccgaaaugaacaagcuguucgagaaaacccggaagcagcucagagaaaacgcggaggacaugggcaaugggugcuuuaagaucuaccacaaaugugauaacgccugcauuggcagcauccgcaauggaacauacgaccaugacguguaucgggaugaggcucugaacaauagauuccagauuaagggcguugaacuuaaaucuggguacaaggacuggauccuguggauuuccuuugccaucagcugcuuccuccugugugugguccugcucggauuuaucaugugggccugccaaaaaggcaacauucgcuguaauaucugcauuuga

SEQ ID NO: 191526 - RNA, 1701 nt, Artificial Sequence
  derived and/or modified sequence opt5 from hemagglutinin__InfluenzaA__AFG72449
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcuauucuccgcaccggauccuggacgggaauaacuguacccucaucgaugcccugcugggagacccccauugcgauggcuuucagaauaaagagugggaccucuucgucgaacgcagcaaggccuacuccaacuguuauccuuacgaugugcccgacuaugcuucucugagaagccuuguugccuccagcgggacgcuggaguuuauuaaugaagauuucaacuggaccggaguggcucaggacggcaaaucuuacgccugcaagcggggcuccgucaagggguuuuucagccgccucaauuggcugcacaaacuugaguauaaguacccugcgcugaacgugacaaugcccaauaacggaaaauuugauaagcucuacaucuggggcguucaucacccuucuaccgacuccgaucaaacaagccuguaugugagagccucugggggagucaccguguccacgaaacggagccagcagacagugauuccguccaucggcucucgccccugggucagagggcugagcucccggauuagcaucuacuggaccauuguuaagccuggagacauccuccugaucaauucuacaggcaaccuuauugcuccccgcggcuauuucaagaucagaaacgggaaauccagcauuaugcggucugacgccccuaucggaaauuguagcuccgagugcauuacccccaacggcucuaucccgaaugauaagccuuuucagaacgugaaucgcaucaccuacggggcuugucccagauaugugaaacaaaacacacugaagcucgccacgggaaugcggaaugucccugaaaaacagacccgcggcauuuucggggcgaucgccggauuuauugagaacggcugggaaggcaugguggacgggugguacggauucagacaccagaauagcgagggcacagggcaggcugccgaucugaaguccacccaagcugccaucgaccagauuaacggaaaacuuaaucggcugaucgagaagacaaacgaaaaguuucaucagaucgagaaagaguucagcgaaguugaaggccgcauucaagaucucgagaaguauguggaggacaccaaaaucgaucuguggucuuacaaugccgaacugcucgucgcucuggagaaccagcacacgauugaccuuacagauuccgaaaugaauaagcuguucgagagaacccggaaacagcucagagaaaacgcggaggacauggggaacggcugcuuuaagaucuaccauaagugugauaaugccugcauuggaagcauccgcaacggcaccuaugaccacgacguguaccgggaugaggcucugaauaacagauuccagauuaaagggguugaacuuaagucuggauauaaagacuggauccuguggaucuccuuugccauuagcugcuuccuccugugugugguccugcucggcuuuaucaugugggccugccaaaaggggaauauucgcuguaacaucugcauuuga

SEQ ID NO: 191527 - RNA, 1701 nt, Artificial Sequence; identical to SEQ ID NO: 184077
  derived and/or modified sequence opt5 from hemagglutinin__InfluenzaA__AFG72460

SEQ ID NO: 191528 - RNA, 1701 nt, Artificial Sequence
  derived and/or modified sequence opt5 from hemagglutinin__InfluenzaA__AFG72504
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaagagcuuuuucucucgccucaacuggcugcacaaacuugaguacaaauauccugcgcugaaugugacaaugcccaacaaugggaaguuugacaaacucuacaucuggggaguucaucacccuuccaccgauagcgaccaaacaucucuguacgugagagccuccggccgggucaccgugagcacgaagcgcucccagcagacagugauuccgaacaucggguucagacccuggguccggggacugucuagccgcauuuccaucuauuggaccauuguuaagccuggcgacauccuccugaucaauagcacagggaaccuuauugcucccagaggauacuuuaaaauccggaacggcaagucuuccauuauccgcagcgaugccccuauuggcaauuguucuagcgagugcaucacccccaacggguccaucccgaaugacaaaccuuuccagaacgugaauagaauuaccuauggagcuuguccccgguacgugaagcaaaacacacugaaacucgccacgggcaugcgcaaugucccugaaaagcagaccagagggaucuuuggagcgauugccggcuucaucgagaacgggugggaaggaaugguggauggcugguauggcuuucggcaccaaaauucugaggggacaggacaggcugccgaccugaaaagcacccaggcugccauugaucagaucaacggcaaacuuaauagacugaucgagaagacaaacgaaaaguuccaucagauugagaaggaguucuccgaaguugaagggcgcauccaagaccucgagaaauacguggaggauaccaagauugaccuguggagcuauaaugccggacugcucgucgcucuggaaaaccagcacacgaucgaucuuacagacucugagaugaauaaacuguuugaacggaccagaaagcagcuccgcgagaacgcggaagauaugggcaacgggugcuucaagauuuaccauaaaugugacaaugccugcaucggcuccauucggaacggaaccuacgaccacgauguguauagagacgaggcucugaauaaccgcuuucagaucaagggcguugagcuuaaaagcggguacaaggauuggauccuguggauuucuuucgccaucuccugcuuucuccugugugugguccugcucggauucauuaugugggccugccaaaaaggcaauauccgguguaacauuugcaucuga

SEQ ID NO: 191529 - RNA, 1701 nt, Artificial Sequence
  derived and/or modified sequence opt5 from hemagglutinin__InfluenzaA__AFG72515
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuauuaacgaaaauuucaacuggaccggaguggcucaggacggcaagagcuaugccugcaagcggggcucugucaauuccuuuuucagccgccucaacuggcugcacaaacuugaguacaaguaucccgcgcugaaugugacaaugccuaacaaugggaaauuugauaagcucuacaucuggggaguucaucacccgucuaccgacuccgaucaaacaagccuguacgugagagccucuggccgggucaccguguccacgaaacgcagccagcagacagugauucccgacaucggguauagaccuuggguccggggacuguccucucgcauuagcaucuacuggaccauuguuaagcccggcgacauccuccugaucaacuccacagggaaccuuauugcuccuagaggauauuucaagauccggaauggcaaaagcucuauuaugcgcuccgaugcccccaucggcaacuguagcucugagugcauuaccccgaaugggagcaucccuaacgacaagcccuuucagaaugugaacagaaucaccuacggagcuuguccucgguaugugaaacaaaauacacugaagcucgccacgggcaugcgcaacguccccgaaaaacagaccagagggauuuucggagcgaucgccggcuuuauugagaaugggugggaaggaaugguggauggcugguacggcuuccggcaccagaacuccgaggggacaggacaggcugccgaccugaagucuacccaagcugccaucgaucagauuaauggcaaacuuaacagacugguugagaagacaaaugaaaaguuucaucagaucgagaaagaguucagcgaaguggaagggcgcauccaagaccucgagaaguaugucgaggauaccaaaauugaccugugguccuacaacgccgaacugcucguggcucuggagaaucagcacacgaucgaucuuacagacagcgaaaugaacaagcuguucgagcggaccagaaaacagcuccgcgaaaacgcggaggauaugggaaauggcugcuuuaagauuuaccauaagugugacaacgccugcaucgggucuauucggaauggcaccuaugaccacgauguuuacagagacgaggcucugaacaaucgcuuccagaucaaaggaguggaacuuaaguccggcuauaaagauuggauucuguggaucagcuuugccaucucuugcuuccuccugugugucgugcugcucggguuuauuaugugggccugccaaaagggaaacauccgguguaauauuugcaucuga

SEQ ID NO: 191530 - RNA, 1701 nt, Artificial Sequence
  derived and/or modified sequence opt5 from hemagglutinin__InfluenzaA__AFG72526
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccucuuguuacccuuaugacgugcccgauuacgcuagccugagaucccuuguugccagcucugggacgcuggaguuuauuaaugaagacuucaacuggaccggaguggcucaggauggcaaguccuaugccugcaagcggggcagcgucaauucuuucuucucccgccucaacuggcugcacaaacuugaguacaaguauccugcgcugaaugugacaaugcccaacaaugggaaauuugacaagcucuacaucuggggaguucaucacccuagcaccgauucugaccaaacaucccuguacgugagagccagcggccgggucauuguguccaccaaacgcucucagcagacggugaucccgaacauugggagcagacccuggguccggggacuguccagccgcaucucuauuuauuggacaaucguuaagccuggcgacauccuccugauuaauuccaccgggaaccuuaucgcucccagaggauacuucaagauucggacaggcaaaagcucuaucaugcgcagcgaugccccuauuggcaacuguuccucugagugcaucacccccaaugggagcaucccgaacgacaagccuuuucagaaugugaacagaauuaccuauggagcuuguccccgguacgugaaacaaaauacacugaagcucgccacgggcaugcgcaacgucccugaaaaacagaccagagggaucuucggagcgauugccggcuuuaucgagaaugggugggaaggaaugguggauggcugguauggcuuccggcaccagaacuccgaggggacaggacaggcugccgaccuuaagagcacccaaacagcuauuaaucagaucaacggcaaacugaauagacugaucgagaagaccaacgaaaaguuucaucagauugagaaagaauuuucugagguugaagggcgcauccaagaucucgagaaguacguggaggacacgaaaauugaucugugguccuauaaugccgaacugcucgucgcccuggagaaccagcacacaaucgaccuuaccgauagcgaaaugaauaagcuguucgagcggaccagaaaacagcuccgcgaaaacgcugaggacaugggaaacggcugcuuuaagauuuaccauaagugugauaaugcgugcaucgggucuauucggaacggcacauacgaccacgacguguauagagaugaggcccugaauaaccgcuuccagaucaaaggaguugaacuuaaguccggcuacaaagacuggauccuguggauuagcuuugcuaucuccugcuuccuccugugugugguccugcucggguuuauuaugugggccugccaaaagggaaauauccgguguaacauuugcaucuga

SEQ ID NO: 191531 - RNA, 1701 nt, Artificial Sequence
  derived and/or modified sequence opt5 from hemagglutinin__InfluenzaA__AFG72581
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggcggggucaccgugagcacgaaacggucccagcagacagugauuccgaauaucggauaucgccccugggucagaggccugucuagccggauuuccaucuacuggaccauuguuaagccuggggacauccuccugaucaacagcacaggaaaccuuauugcuccccgcggcuauuucaagaucagaaauggcaaaucuuccauuaugcggagcgaugccccuaucgggaacuguucuagcgagugcauuacccccaauggauccaucucuaacgacaagccguuucagaaugugaaccgcaucaccuacggcgcuuguccuagauaugugaaacaaaauacacugaagcucgccacggggaugcggaacguccccgaaaaacagacccgcggaauuuucggcgcgaucgccggguuuauugagaauggaugggaaggcaugguggauggcugguacggguucagacaccagaacagcgagggaacaggccaggcugccgaccugaaguccacccaagcugccaucgaucagauuaaugggaaacuuaaccggcugaucgagaagacaaaugaaaaguuucaucagaucgagaaagaguucagcgaaguugaaggacgcauucaagaccucgagaaguauguggaggauaccaaaaucgaccuguggucuuacaacgccgaacugcucgucgcucuggagaaucagcacacgauugaucuuacagacuccgaaaugaacaagcuguucgagagaacccggaaacagcucagagaaaacgcggaggauaugggcaaugggugcuuuaagaucuaccauaagugugacaacgccugcauuggcagcauccgcaauggaaccuaugaccacgauguguaccgggacgaggcucugaacaauagauuccagauuaaaggcguugaacuuaagucuggguauaaagauuggauccuguggaucuccuuugccauuagcugcuuccuccugugugugguccugcucggauuuaucaugugggccugccaaaagggcaacauucgcuguaauaucugcauuuga

SEQ ID NO: 191532 - RNA, 1701 nt, Artificial Sequence
  derived and/or modified sequence opt5 from hemagglutinin__InfluenzaA__AFG72603
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaagcuggaguacaaauauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucggcaauuguaaaagcgagugcauuacccccaacggguccaucccgaaugacaagccuuuucaaaacgugaaucgcaucacauauggagcuugucccagauacgugaaacagaacacgcuuaagcuggccaccggcaugcggaaugucccugaaaaacagacacgcgggauuuucggagcgaucgccggcuuuauugagaacgggugggaaggaaugguggauggcugguauggcuucagacaccaaaauucugaggggaccggacaggcugccgaccucaagagcacacaggcugccaccgaucagaucaacggcaagcugaaucggcuuauugagaaaacgaacgaaaaguuucaucaaaucgagaaagaguucuccgaaguugaagggagaauccaggaccuggagaaguacguggaggauacaaaaauugaccucuggagcuauaaugccgaacugcuggucgcucucgagaaccagcacaccaucgaucugaccgacucugaaaugaauaaacuuuucgagcgcacacggaagcagcugagagaaaacgcggaggauaugggaaacggcugcuuuaagauuuaccauaagugugacaaugccugcaucggguccauucgcaacggcaccuacgaccacgauguguaucgggacgaggcucucaauaacagauuccaaaucaaaggaguugaacuuaagagcggcuacaaagauuggauucuuuggaucucuuuugccaucuccugcuuccugcucugugugguccugcugggguuuauuaugugggccugccagaagggaaauauccgcuguaacauuugcaucuga

SEQ ID NO: 191533 - RNA, 1701 nt, Artificial Sequence
  derived and/or modified sequence opt5 from hemagglutinin__InfluenzaA__AFG72614
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuauuccugcaagcgggggagcgucaagucuuucuucucccgccucaacuggcugcacaaacuugaguacaaguauccugcccugaauguggcgaugcccaacaaugauaaauuugacaagcucuacauuuggggaguucaucacccuagcacagauucugaccaaaccucccuguacgugcaggccagcggcagagucacgguguccacaaaacggucucagcagaccgugaucccgaacauugggagccgccccugggucagaggaguuuccagccggaucucuauuuauuggacaaucgugaagccuggcgacauucugcucaucaauuccaccgggaaccugaucgcuccccgcggauacuucaagauuagaagcggcaaaucuagcaucaugcgguccgaugccccuauuggcaacuguaauucugagugcaucacccccaacgggagcauuccgaaugacaagccuuuucaaaacgugaaucgcaucacauauggagcuugucccagauacgucaaacagaacacgcuuaagcuggccaccggcaugcggaaugugccugaaaaacagacacgcgggaucuucggagcgauugccggcuuuaucgagaacgggugggaaggaaugguugauggcugguauggcuucagacaccaaaauuccgaggggaccggacaggcugccgaccucaagagcacacaggcugccauuaaccagaucaauggcaaacugaaccggcuuauugagaagaccaaugaaaaguuucaucaaaucgagaaagaauuuucugagguggaagggagaauccaggaucuggagaaguacgucgaggacacgaaaauugaucucugguccuauaacgccgaacugcugguggcucucgagaaucagcacacaaucgaccugaccgauagcgaaaugaacaaacuuuucgagcgcacccggaagcagcugagagaaaacgcggaggacaugggaaauggcugcuuuaagauuuaccauaagugugauaacgccugcaucgggucuauucgcaauggcacauacgaccacgacguuuaucgggaugaggcucucaacaauagauuccaaaucaaaggaguggaacugaaguccggcuacaaagacuggauucuuuggaucagcuuugccaucuccugcuuccugcucugugucgugcugcugggguuuauuaugugggccugccagaagggaaacauccgcuguaauauuugcaucuga

SEQ ID NO: 191534 - RNA, 1701 nt, Artificial Sequence
  derived and/or modified sequence opt5 from hemagglutinin__InfluenzaA__AFG72625
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaaucagcucccggauuagcaucuauuggaccauuguuaagccuggcgacauccugcucaucaagucuaccgggaaucugauugcuccccgcggauacuucaaaaucagauccggcaagagcucuauuaugcggagcgaugccccuaucggcaacuguaacuccgagugcauuacacccaaugggucuaucccgaacgacaaaccuuuucaaaaugugaaccgcaucacguauggagcuugucccagauacgugaagcagaauacccuuaaacuggccacaggcaugcggaacgucccugaaaagcagacccgcgggauuuucggagcgaucgccggcuuuauugagaaugggugggaaggaaugguggauggcugguauggcuucagacaccagaacagcgaggggacaggacaagcugccgaccucaaauccacccaggcugccaucaaucagauuaacggcaagcugaaucggcuuaucgagaagacgaacgaaaaauuucaucaaaucgagaaggaguucagcgaaguugaagggcgcauucaggaucuggagaaauacguggaggacacaaagaucgaucucuggucuuauaaugccgaacugcuggucgcucucgagaaccagcacaccauugaccugaccgauuccgaaaugaauaaacuuuucgagagaacacggaagcagcugagagaaaacgcggaggacaugggaaacggcugcuuuaagaucuaccauaaaugugauaaugccugcauugggagcauccgcaacggcaccuacgaccacgacguguaucgggaugaggcucucaauaacagauuccaaauuaagggaguugaacugaaaucuggcuacaaggacuggauccuuuggaucuccuuugccauuagcugcuuccugcucugugugguccugcugggguuuaucaugugggccugccagaaaggaaauauucgcuguaacaucugcauuuga

SEQ ID NO: 191535 - RNA, 1701 nt, Artificial Sequence
  derived and/or modified sequence opt5 from hemagglutinin__InfluenzaA__AFG72636
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaagagcuuuuucucucgccucaacuggcugcacaaacuugaguuuaaauacccugcgcugaaugugaccaugcccaacaaugauaaguucgacaaacucuauauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuacuggacaauuguuaagccuggcgacauccugcucaucaauucuaccgggaaccugauugcuccccgcggauauuuuaaaaucagaaacggcaaguccagcauuaugcggucugaugccccuaucgacaauuguaacagcgagugcauuacccccaauggcuccaucccgaacgauaaaccuuuccaaaaugugaaccgcaucacauacggggcuugucccagauaugugaagcagaauacgcuuaaacuggccaccggaaugcggaacgucccugaaaagcagacacgcggcauuuuuggggcgaucgccggauucauugagaauggcugggaagggaugguggacggaugguacggcuuuagacaccagaacucugagggcaccgggcaagcugccgaucucaaaagcacacaggcugccaucgaccagauuaauggaaagcugaaccggcuuaucgagaagaccaaugaaaaauuccaucaaaucgagaaggaguucuccgaaguugaaggccgcauucaggaucuggagaaauauguggaggacacgaagaucgaucucuggagcuacaacgccgaacugcuggucgcucucgagaaucagcacacaauugaccugaccgauucugaaaugaacaaacuuuuugagagaacccggaagcagcugagagaaaacgcggaggacauggggaauggaugcuucaagaucuaucauaaaugugacaacgccugcauuggcuccauccgcaaugggacauacgaucacgacguguaccgggaugaggcucucaacaauagauuucaaauuaagggcguugaacugaaaagcggauauaaggacuggauccuuuggaucucuuucgccauuuccugcuuucugcucugugugguccugcugggcuucaucaugugggccugccagaaagggaacauucgcuguaauaucugcauuuga

SEQ ID NO: 191536 - RNA, 1701 nt, Artificial Sequence
  derived and/or modified sequence opt5 from hemagglutinin__InfluenzaA__AFG72658
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucguggaacgcagcaaggcuuauuccaauuguuacccuuaugacguccccgauuacgccucucugagaagccuuguggcuuccagcgggacgcuggaguuuaccaacgaaggauucaauuggacaggcguugcccaggacggcaagucuuaugcgugcaagcggggguccgugaacagcuuuuucucucgccucaauuggcugcacaaacuugaguacaaguauccugcccugaacgucaccaugcccaauaacgauaaauuugacaagcucuacauuuggggagugcaucacccuuccacagauagcgaccaaaccucucuguacguucaggcuuccggcagagugacggucagcacaaaacggucccagcagaccgugaucccgaauauugggucucgccccugggugagaggaaucagcucccggauuagcaucuauuggacaauugucaagccuggcgacauccugcucaucaacucuaccgggaaccugauugcccccagaggauacuucaagaucagaaauggcaaauccagcauuaugcggucugaugcuccuaucgacaacuguaauagcgagugcauuacccccaacggcuccaucccgaaugauaagccuuuucaaaacguuaaucgcaucacauauggggccugucccagauacgugaaacagaacacgcuuaagcuggcgaccggaaugcggaaugugccugaaaaacagacacgcggcauuuucggggccaucgcuggauuuauugagaacggcugggaagggauggucgacggaugguauggcuucagacaccaaaauucugagggcaccgggcaggccgcugaucucaagagcacacaggccgccaucgaccagauuaacggaaaacugaaucggcuuaucgagaagaccaacgaaaaguuucaucaaaucgagaaagaguucuccgaaguggaaggccgcauucaggaucuggagaaguacguugaggacacgaaaaucgaucucuggagcuauaaugcugaacugcugguggcgcucgagaaccagcacacaauugaccugaccgauucugaaaugaacaaacuuuucgagcgcacccggaaacagcugagagaaaaugccgaggacauggggaacggaugcuuuaagaucuaccauaagugugacaaugcuugcauuggcuccauccgcaacgggacauacgaucacgacgucuaucgggaugaggcccucaauaacagauuccaaauuaaaggcguggaacuuaagagcggauacaaagacuggauccuguggaucucuuuugccauuuccugcuuccugcucuguguugugcugcugggcuuuaucaugugggcuugccagaaggggaauauucgcuguaacaucugcauuuga

SEQ ID NO: 191537 - RNA, 1701 nt, Artificial Sequence
  derived and/or modified sequence opt5 from hemagglutinin__InfluenzaA__AFG72680
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcauuaucugcgacucuccgcacagaauccuggaugggaaaaauuguacccucauugacgcccugcugggagauccccauugcgacggcuuucagaacaaggagugggaucucuucgucgaacggagcaaagccuauuccaauuguuacccuuaugacgugcccgauuacgcuucucugcgcagccuuguugccuccagcgggacgcuggaguuuaccaacgaaggauucaauuggacaggcguggcucaggacggcaccucuuaugccugcaagagaggguccgucaagagcuuuuucucucggcucaacuggcugcacaaacuugaguacaaguauccugcgcugaaugugacaaugcccaacaaugauaaauuugacaagcucuacaucuggggaguucaucacccuuccaccgauagcgaccaaacgucucuguacgugcaggccuccggccgcgucacagugagcaccagacggucccagcagacagugauuccgaacaucgggucucgccccugggucagaggaguuagcucccggauuagcaucuauuggaccauugugaaaccuggcgacauccugcucaucaauucuaccgggaaccugauugcuccccgcggauacuucaagaucagauccggcaagagcucuauuaugcggagcgaugccccuaucggcaacuguaauuccgagugcauuacacccaacgggucuaucccgaaugacaaaccuuuucaaaacgugaaucgcaucacguauggagcuugucccagauacgucaagcagaacacccuuaaacuggccacaggcaugcggaaugugccugaaaagcagacccgcgggauuuucggagcgaucgccggcuuuauugagaacgggugggaaggaaugguugauggcugguauggcuucagacaccagaauagcgaggggacaggacaagcugccgaccucaaauccacccaggcugccaucaaccagauuaaucggaagcugaacagacuuaucgagaaaacgaaugaaaaguuucaucaaaucgagaaggaguucagcgaaguggaaggccgcauucaggaucuggagaaauacgucgaggacacaaagaucgaucucuggucuuauaacgccgaacugcugguggcucucgagaaucagcacaccauugaccugaccgauuccgaaaugaacaaacuuuucgagcggacaagaaagcagcugcgcgaaaacgcggaggacauggggaauggaugcuuuaaaaucuaccauaagugugauaacgccugcauuggcagcauccggaaugggaccuacgaccacgacguuuauagagaugaggcucucaacaaucgcuuccaaauuaagggcguggaacugaaaucuggauacaaggacuggauccuuuggaucuccuuugccauuagcugcuuccugcucugugucgugcugcugggcuuuaucaugugggccugccagaaagggaacauucgguguaauaucugcauuuga

SEQ ID NO: 191538 - RNA, 1701 nt, Artificial Sequence
  derived and/or modified sequence opt5 from hemagglutinin__InfluenzaA__AFG72691
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuuaagaacaaagagugggaucucuucgucgaacgcagcacggccuauuccaauuguuacccuuaugacgugcccgauuacgcuucucugagaagccuuguugccuccagcgggacccuggaguuuacaaacgaaggauucaauuggaccggcguggcucaggacggcacaucuuaugccugcaagcggggguccgucaagagcuuuuucucucgccucaacuggcugcacaaacuugaguacaaguauccugcgcugaaugugaccaugcccaacaaugauaaauuugacaagcucuacauuuggggaguucaucacccuuccacggauagcgaccagacaucucuguacgugcaagccuccggcagagucaccgugagcacaaaacggucccagcagaccgugaucccgaacauugggucucgccccugggucagaggaguuagcucccggaucagcauuuauuggaccaucgugaagccuggcgacauucugcucaucaauucuacagggaaccugaucgcuccccgcggauacuucaagauuagauccggcaaaagcucuaucaugcggagcgaugccccuauugacaacuguaauuccgagugcaucacgcccaacggcucuauuccgaaugggaagccuuuucagaacgugaaucgcaucaccuauggagcuugucccagauacgucaaacaaaacacacuuaagcuggccaccggcaugcggaaugugccugaaaaacagacacgcgggaucuucggagcgauugccggcuuuaucgagaacgggugggaaggaaugguugauggcugguauggcuucagacaccagaauagcgaggggaccggacaggcugccgaccucaaguccacgcaagcugccauuaaccagaucaauggcaaacugaaccggcuuauugagaagacaaaugaaaaguuucaucagaucgagaaagaguucagcgaaguggaagggagaauccaagaucuggagaaguacgucgaggacaccaaaauugaucucuggucuuauaacgccgaacugcugguggcucucgagaaucagcacaccaucgaccugacagauuccgaaaugaacaaacuuuucgagcgcacccggaagcagcugagagaaaacgcggaggacaugggaaauggcugcuuuaagauuuaccauaagugugauaacgccugcaucgggagcauucgcaauggcacauacgaccacgacguuuaucgggaugaggcucucaacaauagauuccagaucaaaggaguggaacugaagucuggcuacaaagacuggauucuuuggaucuccuuugccaucagcugcuuccugcucugugucgugcugcugggguuuauuaugugggccugccaaaagggaaacauccgcuguaauauuugcaucuga

SEQ ID NO: 191539 - RNA, 1701 nt, Artificial Sequence
  derived and/or modified sequence opt5 from hemagglutinin__InfluenzaA__AFG72713
augaagaucauuaucgcccugagcuacauucucugccugguguucgcucagaaacuucccggcaacgacaauuccaccgccacacugugucucgggcaccaugcggucccuaacggaacgcugguuaagaccaucacaaaugaucaaauugaggugaccaacgcuacagaacuugugcagucuagcuccaccggcagaaucugcgacucuccgcaccagauccuggaugggaaaaauuguacacucauugacgcccugcugggagauccccauugcgacggcuuuaagaacaaagagugggaucucuucgucgaacggagcaccgccuauuccaauuguuacccuuaugacgugcccgauuacgcuucucugcgcagccuuguugccuccagcgggacgcuggaguuuaccaacgaaggauucaauuggacaggcguggcucaggacggcaccucuuaugccugcaagagaggguccgucaagagcuuuuucucucggcucaacuggcugcacaaacuugaguacaaguauccugcgcugaaugugacaaugcccaacaaugauaaauuugacaagcucuacaucuggggaguucaucacccuuccaccgauagcgaccaaacgucucuguacgugcaggccuccggccgcgucacagugagcaccaaaagaucccagcagacagugauuccgaacaucgggucucggcccuggguccgcggaauuagcuccagaaucagcauuuauuggaccaucguuaagccuggcgacauccugcucauuucuuccaccgggaaucugaucgcuccccggggauacuucaagauucgcagcggcaaaucuagcaucauuagauccgaugccccuaucgacaacuguaacucugagugcaucacacccaauggcagcauuccgaacgauaagccuuuucaaaaugugaaccggaucacguauggggcuuguccccgcuacgugaaacagaauacccuuaagcuggccacaggaaugagaaacgucccugaaaaacagacccggggcauuuucggggcgaucgccggauuuauugagaauggcugggaagggaugguggacggaugguauggcuuccgccaccagaacuccgagggcacagggcaagcugccgaucucaagagcacccaggcugccaucaaucagaucaacggaaaacugaauagacuuauugagaagacgaacgaaaaguuucaucaaaucgagaaagaguucucugaaguugaaggccggauucaggaccuggagaaguacguggaggauacaaaaaucgaccucugguccuauaaugccgaacugcuggucgcucucgagaaccagcacaccauugaucugaccgacagcgaaaugaauaaacuuuucgagagaacacgcaagcagcugcgggaaaacgcggaggauauggggaacggaugcuuuaagaucuaccauaagugugacaaugccugcauuggcucuaucagaaacgggaccuacgaccacgauguguaucgcgacgaggcucucaauaaccgguuccaaaucaaaggcguugaacugaaguccggauacaaagauuggauucuuuggaucagcuuugccauuuccugcuuccugcucugugugguccugcugggcuuuaucaugugggccugccagaaggggaauauuagauguaacaucugcaucuga

SEQ ID NO: 191540 - RNA, 1701 nt, Artificial Sequence
  derived and/or modified sequence opt5 from hemagglutinin__InfluenzaA__AFG72724
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaguuagcucccggaucagcauuuauuggaccaucgugaagccuggcgacauucugcucaucaauucuaccgggaaccugaucgcuccccgcggauacuucaagauuagauccggcaaaagcucuaucaugcggagcgaugccccuauugacaacuguaauuccgagugcaucacacccaacggcucuauuccgaaugauaagccuuuucaaaacgugaaucgcaucacguauggggcuugucccagauacgucaaacagaacacccuuaagcuggccacaggaaugcggaaugugccugaaaaacagacccgcggcaucuucggggcgauugccggauuuaucgagaacggcugggaagggaugguugacggaugguauggcuucagacaccagaauagcgagggcacagggcaagcugccgaucucaaguccacccaggcugccauuaaccagaucaauggaaaacugaaccggcuuauugagaagacgaaugaaaaguuucaucaaaucgagaaagaguucagcgaaguggaaggcagaauccaggaccuggagaaguacgucgaggauacaaaaauugaccucuggucuuauaacgccgaacugcugguggcucucgagaaucagcacaccaucgaucugaccgacuccgaaaugaacaaacuuuucgagcgcacacggaagcagcugagagaaaacgcggaggauauggggaauggaugcuuuaagauuuaccauaagugugacaacguuugcaucggcagcauucgcaaugggaccuacgaccacgauguguaucgggacgaggcccucaacaauagauuccaaaucaaaggcgucgaacugaagucuggauacaaagauuggauucuuuggaucuccuuugcuaucagcugcuuccugcucugugugguccugcugggcuuuauuaugugggccugccagaaggggaacauccgcuguaauauuugcaucuga

SEQ ID NO: 191541 - RNA, 1701 nt, Artificial Sequence
  derived and/or modified sequence opt5 from hemagglutinin__InfluenzaA__AFG72735
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuuaagaacaaagagugggaucucuucgucgaacgcagcacggccuauuccaauuguuacccuuaugacgugcccgauuacgcuucucugagaagccuuguugccuccagcgggacccuggaguuuacaaacgaaggauucaauuggaccggcguggcucaggacggcacaucuuaugccugcaagcggggguccgucaagagcuuuuucucucgccucaacuggcugcacaaacuugaguacaaguauccugcgcugaccgugacgaugcccaauaacgauaaauuugacaagcucuacauuuggggaguucaucacccuuccacagauagcgaccagaccucuaucuacgugcaagccuccggcagagucacagugagcaccaaacggucccagcagaccgugauuccgaauaucgggucucgccccugggucagaggaguuagcucccggauuagcaucuauuggacaauugugaagccuggcgacauccugcugaucaacucuacggggaaucucauugcuccccgcggauacuucaagaucagauccggcaaaagcucuauuaugcggagcgaugccccuaucgacaacuguaacuccgagugcauuacccccaauggcucuaucccgaacgauaagccuuuucagaaugugaaccgcaucacauauggggcuugucccagauacgucaaacaaaauacccugaaacuugccacaggaaugcggaacgugccugaaaagcagacccgcggcauuuucggggcgaucgccggauuuauugagaauggcugggaagggaugguugacggaugguauggcuucagacaccagaacagcgagggcacggggcaggcugccgaucugaaguccacacaagcugccaucaaucagauuaacggaaaacucaaucggcugaucgagaagaccaacgaaaaguuucaucagaucgagaaagaguucagcgaaguggaaggccgcauucaagaccuugagaaguacgucgaggauaccaaaaucgacauuuggucuuauaaugccgaacugcucguggcucuggagaaccagcacacaaucgaucugaccgacuccgaaaugaauaaacucuucgagagaacacggaagcagcugagagaaaacgcggaggauauggggaacggaugcuuuaagauuuaccauaagugugacaaugccugcaucggcagcauucgcaacgggacguacgaccacgauguuuaucgggacgaggcucuuaauaacagauuccagaucaaaggcguggaacugaagucuggauacaaagauuggauccucuggauuuccuuugccaucagcugcuuccugcuuugugucgugcugcucggcuuuauuaugugggccugccaaaaggggaauauccgcuguaacauuugcaucuga

SEQ ID NO: 191542 - RNA, 1701 nt, Artificial Sequence
  derived and/or modified sequence opt5 from hemagglutinin__InfluenzaA__AFG72757
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggagcucuaucaaguccuuuuucagccgccugaacuggcuccaccaacugaaguacaaauauccugcgcuuaaugucaccaugcccaacaaugacaaguuugauaaacuguacauuuggggcgugcaucacccuucuacagacuccgaucagaccagcaucuacgcccaggcuuccgggagaguuacggugucuacaaagcggagccagcaaaccgucauuccgaacaucggaucccgccccugggugagaggcauuagcucucggaucuccauccacuggacaauugugaaaccuggggacauccuccugauuaacagcaccggaaaucugaucgcuccccgcggcuauuucaagauuagaucuggaaagagcuccaucaugcggucugacgccccuaucgggaaauguaacagcgagugcauuacccccaauggcuccaucccgaacgauaagccuuuucagaaugucaaccgcauuacauacggcgccugucccagauauguuaaacagaauacgcucaagcuggcgaccgggaugcggaacgugccugaaaaacagacacgcggaaucuucggcgccauugcuggguuuaucgagaauggaugggaaggcaugguggacgggugguacggauucagacaucaaaacagcgagggcaccggccaggccgcugaucuuaagucuacacaggccgccaucaaucaaauuaacgggaaacugaaucggcucaucgagaagaccaacgaaaaguuucaccagauugagaaagaguucuccgaagucgaaggaagaauccaggaccuggagaaguauguggaggauacgaaaauugaccuuuggagcuacaaugcugaacugcucguugcgcuggagaaccagcauacaaucgaucugaccgacucugaaaugaacaagcuguucgagcgcacccggaaacaacugagagaaaaugccgaggauaugggcaacgggugcuuuaagauuuaucacaagugugacaaugcuugcaucggauccauccgcaacggcacauacgaucacgacguguaccgggacgaggcccuuaauaacagauuccagauuaaaggggucgaacucaagagcggcuauaaagauuggauccucuggauuuccuuugccaucucuugcuuccugcuuugugugguucugcucggauuuauuaugugggcuugccagaagggcaauauccgcuguaacaucugcauuuga

SEQ ID NO: 191543 - RNA, 1701 nt, Artificial Sequence
  derived and/or modified sequence opt5 from hemagglutinin__InfluenzaA__AFG72779
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuuccgggcggguuacggugucuacacgcagaagccagcaaaccgucauuccgaacaucggaucccggcccugggugcgcggcgugagcucugggauuuccaucuacuggacaauugucaagccuggagacauccugcucaucaacagcaccggcaaucugauugcccccagaggguauuucaaaauccggucuggaaagagcuccauuaugcgcucugacgcuccuaucggcaaguguaacagcgagugcauuacccccaauggcuccaucccgaacgauaaaccuuuucagaauguuaacagaaucacauacggggccuguccccgguaugugaagcagaauacgcuuaaacuggcgaccggaaugcgcaacgugccugaaaagcagacaagaggcauuuucggggccaucgcuggauuuauugagaauggcugggaagggauggucgacggaugguacggcuuccggcaccaaaacagcgagggcaccgggcaggccgcugaucucaaaucuacacaggccgccaucaaucaaauuaacggaaagcugaauagacuuaucgagaaaaccaacgaaaaguuucaucagaucgagaaggaguucuccgaaguggaaggccgcauucaggaccuggagaaauauguugaggauacgaagaucgaccucuggagcuacaaugcugaacugcugguggcgcucgagaaccagcacacaauugaucugaccgacucugaaaugaacaaacuuuucgagcggaccagaaagcaacugcgcgaaaaugccgaggauauggggaacggaugcuuuaaaaucuaucauaagugugacaaugcuugcauuggcuccauccggaacgggacauacgaucacgacgucuacagagacgaggcccucaauaaccgcuuccagauuaagggcguggaacugaaaagcggauauaaggauuggauccuuuggaucuccuuugccauuucuugcuuccugcucuguguugugcugcugggcuuuaucaugugggcuugccagaaagggaauauucgguguaacaucugcauuuga

SEQ ID NO: 191544 - RNA, 1701 nt, Artificial Sequence
  derived and/or modified sequence opt5 from hemagglutinin__InfluenzaA__AFG72801
augaagaccaucauugcccugagcuacauccucugccugguguucgcucagaaacuucccggcaacgacaauuccacagccacgcugugucucgggcaccaugcggucucuaacggaacccugguuaagacaauuaccaaugaucaaaucgaggugacaaacgcuaccgaacuugugcagagcuccucuacaggcagaauuugcgacagcccucaccagauccuggauggggagaauuguacccucaucgacgcccugcugggagauccgcauugcgacggcuuucagaacaaagaaugggaucucuucgucgagcgguccaaggccuauucuaauuguuaccccuaugacgugccugauuacgcuagccugcgcucccuuguugccagcucugggacgcuggaauuuaacaaugaguccuucaacuggaccggaguggcucaaaauggcacaagcucugccugcaaaagacgguccaacaagagcuuuuucucucgccucaauuggcugcaccagcuuaaguauaaauaccccgcgcugaacgucaccaugccuaauaacgagaaguuugacaaacucuauauuuggggcgugcaucaccccuccacagauagcgaccagaucuccauuuacgcccagucuagcgggagaguuaccguguccacgaagcggagccaacagacagucaucccuaacauuggaucuuccccgugggugcgcggcgugagcucuagaaucagcauuuacuggaccaucgucaaacccggggauauccugcugauuaauuccacaggaaaccucaucgcuccucggggcuauuucaagauucgcucuggaaagagcuccaucaugagaagcgacgcccccauugggaaauguaauucugaaugcaucaccccuaacggcuccauccccaaugacaagccguuucagaacguuaaucggauuaccuacggcgcuuguccucgcuaugugaaacagaacacacugaaacuugccacggggaugagaaaugugcccgagaagcaaacccggggaaucuucggcgcgauugccggguuuaucgaaaacggaugggagggcauggucgaugggugguacggauuccgccaccagaauagcgagggcacaggccaggcugccgaccugaagucuacccaagcugccauuaaccagaucaaugggaaacucaacagacugaucgaaaagacaaaugagaaguuucaucagauugaaaaagaguucuccgaaguggagggacggauccaggaucuugagaaguauguugaagacaccaaaauugaucuguggagcuacaacgccgagcuccugguggcucuggaaaaccaacacacgaucgaccucacagauuccgagaugaauaagcuguucgaaagaaccaaaaagcagcuucgcgagaacgcggaggacaugggcaaugggugcuuuaagauuuaucauaaaugugauaacgccugcaucggaucuauucggaauggcaccuacgaccacgaugucuacagagacgaagcucugaacaaucgcuuccagaucaaggggguggagcucaaaagcggcuauaaggacuggauccuguggauuuccuuugccaucucuugcuuccuucuguguguugugcuccugggauuuauuaugugggccugccagaaaggcaacauccgguguaauauuugcaucuga

SEQ ID NO: 191545 - RNA, 1701 nt, Artificial Sequence
  derived and/or modified sequence opt5 from hemagglutinin__InfluenzaA__AFG72812
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaaguauaaauacccugcccugaacgugaccaugcccaauaacgagaaguuugacaaacucuauauuuggggcguucaucacccugggacagauucugaccagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagauauccugcucaucaauuccacaggcaaccugauugcuccccgcggguauuucaagaucagaagcggaaagucuagcauuaugcgguccgacgccccuaucggcaaauguaauucugaaugcauuacccccaacggcagcaucccgaaugacaagccuuuucagaacgugaaucgcaucaccuacggggcuugucccagauaugugaaacagaacacacuuaagcuggccacgggaaugcggaaugucccugagaaacaaacccgcggcauuuucggggcgaucgccggauuuauugaaaacggcugggaggggaugauggauggaugguacggcuucagacaccucaauuccgagggcacagggcaggcugccgaccuuaagagcacccaggcugccaucaaccaaauuaauggaaaacugaaccggcugaucgaaaagacaaaugagaaguuucaucagaucgaaaaagaguucucugaaguggagggccgcauucaggaucucgagaaguauguugaagacaccaaaaucgaucugugguccuacaacgccgagcugcucguggcucuggaaaaccagcacacgauugaccuuacagauagcgagaugaauaagcuguucgaaagaaccaaaaagcaacuccgggagaacgcggaggacauggggaauggaugcuuuaagaucuaucauaaaugugauaacgccugcauuggcucuaucagaaaugggaccuacgaccacgaugucuaccgcgacgaagcucugaacaaucgguuccagauuaagggcguggagcuuaaauccggauauaaggacuggauccuguggaucagcuuugccauuuccugcuuccuccuguguaucguucugcucggcuuuauuaugugggccugccagaaagggaacaucagauguaauauuugcaucuga

SEQ ID NO: 191546 - RNA, 1701 nt, Artificial Sequence
  derived and/or modified sequence opt5 from hemagglutinin__InfluenzaA__AFG72823
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcuccacccugggacggauucugaccagauuucccuguacgcgcaggccagcggccgcaucacaguuuccaccaaaagaucucaacagacagugauuccgaacaucgggagccggccccgcgucagaggaguguccagccggauuucuaucuacuggaccaucgugaagccuggcgauauucugcucaucaauuccaccgggaaccugauugcuccccgcggauauuucaagaucagaagcggcaaaucuagcauuaugcgguccgacgccccuaucggcaaguguaauucugagugcaucacacccaacgggagcauuccgaaugacaaaccuuuucagaacgucaaucgcaucacguacggagcuugucccagauauauuaagcagaacacccuuaaacuggccacaggcaugcggaauguuccugaaaagcaaacccgcgggaucuucggagcgauugccggcuuuaucgagaacgggugggaaggaaugguggauggcugguacggcuucagacaucaaaauuccgaggggacaggacaggcugccgaccucaaaagcacccaggcugccaucaaccagauuaauggcaagcugaaccggcuuaucgggaagacgaaugagaaauuucaccagauugaaaaggaguucucugaaguggagggaagaauccaggaucuggaaaaauaugucgaggacacaaagauugaucucugguccuacaacgccgagcugcugguggcucucgaaaaccaacacaccaucgaccugaccgauagcgagaugaauaaacuuuucgaacgcacaaagaagcagcugcgggagaacgcggaagacaugggcaaugggugcuuuaaaauuuaucauaagugugauaacgccugcaucggcucuaucagaaauggaaccuacgaccacgauguuuaccgcgacgaggcucucaacaaucgguuccagauuaaaggcguggagcugaaguccggguauaaagacuggauccuuuggauuagcuuugccaucuccugcuuccugcucugugucgcccugcugggauuuauuaugugggcuugccagaagggcaacaucagauguaauaucugcauuuga

SEQ ID NO: 191547 - RNA, 1701 nt, Artificial Sequence
  derived and/or modified sequence opt5 from hemagglutinin__InfluenzaA__AFG72834
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaaguauaaauacccugcccugaacgugaccaugcccaauaacgagaaguuugacaaacucuauauuuggggcguucaucacccugggacagauucugaccagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagauauccugcucaucaauuccacaggcaaccugauugcuccccgcggguauuucaagauccagagcggaaagucuagcauuaugagauccgacgccccuaucggcaaauguaauucugaaugcauuacccccaacggcagcaucccgaaugacaagccuuuucagaacgugaaucggaucaccuacggggcuuguccccgcuaugugaaacaaaacacacuuaagcuggccacgggaaugagaaaugucccugagaaacagacccggggcauuuucggggcgaucgccggauuuauugaaaacggcugggaggggaugauggauggaugguacggcuuccgccaccaaaauuccgagggcacagggcaggcugccgaccucaagagcacccaggcugccaucaaccagauuaauggaaaacugaacagacuuaucgaaaagacaaaugagaaguuucaucagaucgaaaaagaguucucugaaguggagggccggauucaagaucuggagaaguauguugaagacaccaaaaucgaucucugguccuacaacgccgagcugcugguggcucucgaaaaccagcacacgauugaccugacagauagcgagaugaauaaacuuuucgaaagaaccaagaagcagcugcgcgagaacgcggaggacauggggaauggaugcuuuaagaucuaucauaaaugugauaacgccugcauuggcucuauccggaaugggaccuacgaccacgaugucuacagagacgaagcucucaacaaucgcuuccagauuaagggcguggagcugaaauccggauauaaggacuggauccuuuggaucagcuuugccauuuccugcuuccugcucuguaucguucugcugggcuuuauuaugugggccugccaaaaagggaacauccgguguaauauuugcaucuga

SEQ ID NO: 191548 - RNA, 1701 nt, Artificial Sequence
  derived and/or modified sequence opt5 from hemagglutinin__InfluenzaA__AFG72845
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuagauauaaguacccugcccugaaugugaccaugcccaacaaugagaaauuugauaagcucuauauuuggggcguucaucacccuggcacagacuccgaucagaucagccuguacgcgcaggccuccgggcgggugaccauuucuacgaaacgcagccaacagacagucaucccgaacauuggauccagacccugggugcggggcgugagcucucgcaucuccauucacuggaccaucgucaagccuggggacauccugcucauuaacagcacaggaaaucugaucgcucccagaggcuacuucaaaauucggucuggaaagagcuccaucaugcgcucugacgccccuauugggaaguguaacagcgaaugcaucacccccaauggcuccaucccgaacgauaaaccuuuucagaauguuaacagaauuaccuauggcgcuuguccccgguacgugaagcagaaaacacuuaagcuggccacggggaugcgcaaugugccugagaaacaaaccagaggaaucuucggcgcgauugccggguuuaucgaaaacggaugggagggcaugauggacgggugguauggauuccggcaucagaauagcgagggcacaggccaggcugccgaucucaagucuacccaagcugccauuaaccagaucaaugggaaacugaacagacuuaucgaaaagacaaaugagaaguuucaccagauugaaaaagaguucuccgaagucgagggacgcauccaggaccuggagaaguacguggaagauaccaaaauugaccucuggagcuauaacgccgagcugcugguugcucucgaaaaucaacauacgaucgaucugacagacucugagaugaacaaacuuuucgaacggaccaagaagcagcugagagagaacgcggaggauaugggcaaugggugcuuuaagauuuaccacaaaugugacaacgccugcaucggauccauucgcaauggcaccuaugaucacgacguguaccgggacgaagcucucaacaauagauuccagaucaagggggucgagcugaaaagcggcuacaaggauuggauccuuuggauuuccuuugccaucucuugcuuccugcucuguauugugcugcugggauuuaucaugugggccugccagaaaggcaacauucgcuguaauaucugcaucuga

SEQ ID NO: 191549 - RNA, 1701 nt, Artificial Sequence
  derived and/or modified sequence opt5 from hemagglutinin__InfluenzaA__AFG72856
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaccaacgaaucuuucaauuggacaggcguuacccagaacggcacauccagcgcuugcaagcgcagaucuaauaaguccuuuuucagccggcugaacuggcucacccaucugaaauauaaguacccugcccuuaaugugacgaugcccaacaaugagaaauuugacaagcuguauauuuggggaguccaccauccugggacagauucugaccagaucucccucuacgcgcaggccagcggccgcauuaccguguccacaaaaagaucucaacagaccguuaucccgaacauugggagccggccccgcgugagagauaucuccagccggaucucuauuuacuggaccaucgucaagccuggagacauucugcugaucaacuccacaggcaaucucauugcuccccgcggguauuucaagaucagaagcggaaaaucuagcaucaugcgguccgacgccccuauuggcaaguguaacucugagugcaucacgcccaauggcagcauuccgaacgauaaaccuuuucagaaugugaaccgcaucaccuacggggcuugucccagauaugugaagcagaauacacugaaacuugccaccggaaugcggaacgucccugaaaagcaaacacgcggcauuuucggggcgaucgccggauuuaucgagaauggcugggaagggaugguugacggaugguacggcuucagacaccagaacuccgagggcaccgggcaggcugccgaucugaaaagcacgcaagcugccauuaaucagaucaacggaaagcucaauaagcugauuggcaaaacaaacgagaaguuucaccagaucgaaaaagaguucucugaaguggaggggcggauucaggaccuugaaaaguauguggaggauaccaaaaucgaccugugguccuacaaugccgagcuccuggucgcucuggaaaaccaacauaccauugaucucacagacagcgagaugaacaagcuguucgaaagaaccaagaaacagcuucgcgagaaugcggaagauaugggaaacggcugcuuuaagaucuaucacaaaugugacaaugccugcaucgggucuauucggaacggcacauacgaucaugacguguacagagacgaggcucugaauaaccgcuuccagaucaagggaguugagcucaaauccggcuauaaggauuggauucuguggaucagcuuugccauuuccugcuuccuucugugugugguccuccugggguuuaucaugugggccugccagaagggaaauauccgguguaacauuugcaucuga

SEQ ID NO: 191550 - RNA, 1701 nt, Artificial Sequence
  derived and/or modified sequence opt5 from hemagglutinin__InfluenzaA__AFG72867
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaagaacaaauauccugcccugaaugugaccaugcccaacaacgagaaguuugacaaacucuacauuuggggcguucaucacccugggacagauucugaccagaucucccuguaugcgcaggccagcggaagagugaccgucuccacgaagcggucucaacagacagugauuccgaauaucggcagccgccccagagugcgggauauuuccagccgcaucucuauuuacuggaccaucgucaaaccuggggacauccugcucauuaacuccacaggaaaucugaucgcucccagaggcuacuucaagauucggagcgggaagucuagcaucaugcgcuccgacgccccuauuggaaaauguaacucugaaugcaucacccccaauggcagcaucccgaacgauaagccuuuucagaauguuaacagaauuaccuauggcgcuuguccccgguacgugaaacagaauacacuuaagcuggccacggggaugcgcaacgugccugagaaacaaaccagaggaaucuucggcgcgauugccggguuuaucgaaaauggaugggagggcaugauggacgggugguauggauuccggcaccagaacuccgagggcacaggccaggcugccgaucucaagagcacccaagcugccauuaaucagaucaacgggaaacugaauagacuuaucgaaaagacaaacgagaaguuucaucagauugaaaaagaguucucugaagucgagggacgcauccaggaccuggagaaguacguggaagauaccaaaauugaccucugguccuauaacgccgagcugcugguugcucucgaaaaucaacacacgaucgaucugacagacagcgagaugaacaaacuuuucgaacggaccaagaagcagcugagagagaaugcggaggauaugggcaacgggugcuuuaagauuuaccauaaaugugacaaugccugcaucggaucuauucgcaacggcaccuaugaucacgacguguaccgggacgaagcucucaauaacagauuccagaucaagggggucgagcugaaauccggcuacaaggauuggauccuuuggauuagcuuugccaucuccugcuuccugcucuguauugugcugcugggauuuaucaugugggccugccagaaaggcaauauucgcuguaacaucugcaucuga

SEQ ID NO: 191551 - RNA, 1701 nt, Artificial Sequence
  derived and/or modified sequence opt5 from hemagglutinin__InfluenzaA__AFG72922
augaagaccaucauugcccugagcuacauccucugccugguguucgcucagaaacuucccggcgacgauaacuccacagccacgcugugucucgggcaccaugcggucccuaauggaaccauuguuaagacaaucaccaacgaccaaauugaggugacaaaugcuaccgaacuggugcagucuagcuccacaggcgagaucugcgauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcucuugcauccgcaaguccaauaacagcuuuuucucuagacugaauuggcucacacaucugaaguuuaaauauccugcucuuaacgucaccaugcccaauaacgagcaguucgauaagcuguacauuuggggcgugcaccauccugggacggacaacgaucagaucuuucucuaugcccaagcguccggacggauuacaguuagcaccaaacgcucccagcagacagugaucccgaauauuggcucuagaccccggguccgcaacaucccuagcagaaucuccauuuacuggaccaucgugaagcccggggacauucugcugaucaauagcaccggaaaccucauugccccucggggcuacuucaaaauccgcucugggaaguccagcaucaugagaucugacgcucccauuggaaaguguaauagcgaaugcaucacaccgaacggcuccauuccuaaugauaaacccuuucagaacgugaaucggaucacguauggcgccuguccucgcuacgucaagcaaaacacccugaaacuugcuacagggaugagaaauguucccgagaagcagacccggggaauuuucggcgccaucgcgggguuuaucgaaaacggaugggagggcaugguggacgggugguauggauuccgccaccaaaauucugagggcagaggccaggccgcugaucugaaaagcacacaggccgcuauugaccagaucaacgggaagcucaaucggcugauuggaaaaaccaacgaaaaguuccaccagaucgagaaggaauuuuccgagguggaaggccgcauucaagaucuugagaaauacgucgaggacacgaagaucgaucuguggagcuauaacgccgaacuccugguggcccuggagaaucagcauacaauugaccucaccgauucugaaaugaacaaacuguucgagaagaccaaaaagcagcuuagagaaaaugcugaggacauggggaacggaugcuuuaagaucuaccacaaaugugauaaugcgugcaucggcuccauucggaacgggacauaugaccaugacguuuacagagaugaggcccugaauaaccgcuuccagaucaagggcguggaacucaaaagcggauacaaggacuggauucuguggaucucuuuugcuauuuccugcuuccuucugugugucgcccuccugggcuuuaucaugugggccugccaaaaagggaauauccgguguaacauuugcaucuga

SEQ ID NO: 191552 - RNA, 1701 nt, Artificial Sequence
  derived and/or modified sequence opt5 from hemagglutinin__InfluenzaA__AFG72933
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcguccgcagaucuaacaauuccuuuuucagccggcugaacuggcucacacaucugaaguuuaaguauccugcccuuaaugugaccaugcccaacaacgagcaguucgacaaacuguacaucuggggcguucaccauccugggacggauaaugaccagauuuuucucuaugcgcaagccucuggacgcaucacaguguccaccaagagaagccagcagacagucauuccgaacaucggcucccggccccgcgugagaaauauuccuucucggaucagcaucuacuggaccauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugucaaccgcauuacguauggcgcuuguccuagauacguuaaacaaaauacccugaaacuugccacagggaugcggaacgugcccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgaggucgaaggccgcauccaagaccuugagaaguacguggaggauacgaaaauugaccugugguccuauaaugccgaacuccugguugcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 191553 - RNA, 1701 nt, Artificial Sequence
  derived and/or modified sequence opt5 from hemagglutinin__InfluenzaA__AFG72955
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacaauuccuuuuucagccggcugaacuggcucacacaucugcgcuuuaaguauccugcccuuaaugugaccaugcccaacaacgagcaguucgacaagcuguacaucuggggcguccaccauccugggacggauaaugaccagauuuuucucuaugcgcaagccucuggaagaaucacaguguccaccaaacggagccagcagacaguuauuccgaacaucggcucccgccccagagugcggaauaucccuucucgcauuagcaucuacuggaccauugucaagcccggggauauccugcugauuaacuccaccggaaaucucaucgcuccuagaggcuacuucaaaauccggagcgggaagucuuccauuaugcgcagcgacgcccccaucggaaaauguaacucugaaugcauuacaccgaauggcagcaucccuaacgacaagcccuuucagaaugugaacagaauuacguauggcgcuuguccucgguacgugaagcaaaauacccugaaacuugccacagggaugcgcaacguccccgagaagcagaccagaggaaucuucggcgcgaucgccggguuuauugaaaauggaugggagggcaugguugaugggugguauggauuccggcaccagaacuccgagggcagaggccaagcugccgaccugaaaucuacacaggcugccaucgaucagauuaaugggaagcucaaccgccugaucggaaaaaccaacgaaaaguuccaccagauugagaaagaauuuagcgagguggaaggccggauccaagaccuugagaaguacguggaggauacgaagauugaccugugguccuauaaugccgaacuccuggucgcucuggagaaccagcauacaaucgaucucaccgacagcgaaaugaauaaacuguucgagaagaccaaaaagcagcuuagagaaaacgcggaggauauggggaauggaugcuuuaaaaucuaccacaagugugacaacgccugcauuggcucuauccgcaaugggacauaugaucaugacguguaccgggacgaggcucugaacaauagauuccagauuaagggcguugaacucaaauccggauacaaggauuggauccuguggauuagcuuugccaucucuugcuuccuucuguguguggcccuccugggcuuuaucaugugggcuugccaaaaagggaacauucgcuguaauaucugcauuuga

SEQ ID NO: 191554 - RNA, 1701 nt, Artificial Sequence; identical to SEQ ID NO: 184664
  derived and/or modified sequence opt5 from hemagglutinin__InfluenzaA__AFG98808

SEQ ID NO: 191555 - RNA, 1701 nt, Artificial Sequence; identical to SEQ ID NO: 184664
  derived and/or modified sequence opt5 from hemagglutinin__InfluenzaA__AFG98819

SEQ ID NO: 191556 - RNA, 1701 nt, Artificial Sequence
  derived and/or modified sequence opt5 from hemagglutinin__InfluenzaA__AFG98830
augaagaccaucauugcccugagcuacaucuucugccucgugcugggccaggaccuucccgggaacgauaaauccacagcuacgcugugucucggacaccaugccgucccuaauggcacccugguuaagacaauuaccaacgaccaaaucgaggugacaaaugcgaccgaacuugugcagucuagcuccacagggaaaauuugcaacaauccgcacagaauccuggauggaaucgacuguacccucauugaugcucugcugggcgacccccauugcgauggguuucagaacgagacgugggaccucuucgucgaacggucuaaggccuuuagcaauuguuauccuuacgaugugcccgacuaugccucccugcgcucucuuguugcuagcuccggaacccuggaguucaucacagaaggcuuuaccuggacaggcgugacccagaacgggggaagcucugccugcaaaagaggcccuggguccggauucuuuagccggcucaauuggcugacgaagucuggcuccacauaccccguccuuaacgugaccaugccuaauaacgauaauuucgacaagcuguauauuuggggaguucaccauccgagcacaaaccaagagcagaccucucucuacgugcaggcuuccgggcgcgucaccgugagcacaagacggucccagcaaacgaucauucccaauaucggcucucgcccuugggugagaggccugagcucccggauuagcaucuauuggaccaucgucaaacccggggauauucugaucauuaacucuaacggaaaucucaucgccccucgcggcuacuuuaagaugagaacagggaaauccagcauuaugcggucugacgcgcccaucgacaccuguaucagcgagugcauuacaccgaacggauccaucccuaaugauaagcccuuccagaacguuaauaaaauuaccuacggcgccuguccuaaguaugugaagcagaacacgcugaaacuugcuacagggaugcgcaaugugcccgaaaagcagaccagaggacuguuuggcgccaucgcuggcuucauugagaacgggugggaaggaaugaucgacggcugguacggguuucggcaccaaaauucugagggaaccggccaggccgcggaucucaaaagcacacaggccgcuaucgaccaaauuaacgggaagcugaaucgcgucaucgagaaaaccaacgaaaaguuccaccagauugagaaagaguucuccgaaguggaaggcagaauccaggaucuugagaaguauguugaggacacaaagauugaucuguggagcuacaaugccgaacuccugguggcucuggagaaccagcauacgaucgaccucaccgauucugaaaugaauaaacuguuugagaagacacggagacaacuucgcgaaaacgccgaggacaugggaaacggcugcuucaaaauuuaucacaagugugauaaugccugcaucggguccauccggaacggaaccuacgaccaugacgucuauagagaugaggcucugaauaaccgcuuucagauuaaaggcguggaacucaagagcggguacaaggacuggauccuguggauuucuuucgcgaucuccugcuuucuucuguguguugugcuccugggauucauuaugugggccugccagaaaggcaauauccgguguaacaucugcauuuga

SEQ ID NO: 191557 - RNA, 1701 nt, Artificial Sequence
  derived and/or modified sequence opt5 from hemagglutinin__InfluenzaA__AFG98841
augaagaccaucauugcccugagcuacaucuucugccucgugcugggccaggaccuucccgggaacgauaaauccacagcuacgcugugucucggacaccaugccgucccuaauggcacccugguuaagacaauuaccaacgaccaaaucgaggugacaaaugcgaccgaacuugugcagucuagcuccacagggaaaauuugcaacaauccgcacagaauccuggauggaaucgacuguacccucauugaugcucugcugggcgacccccauugcgauggguuucagaacgagacgugggaccucuucgucgaacggucuaaggccuuuagcaauuguuauccuuacgaugugcccgacuaugccucccugcgcucucuuguugcuagcuccggaacccuggaguucaucacagaaggcuuuaccuggacaggcgugacccagaacgggggaagcaaugccugcaaaagaggcccugggucuggauucuuuucccggcucaacuggcugacaaagagcggcucuacguaccccguccuuaaugugaccaugccuaacaaugauaacuucgacaagcuguauauuuggggaguucaccauccguccacaaaucaagagcagaccagccucuacgugcaggcuucugggcgcgucaccguguccacaagacggagccagcaaacgaucauucccaacaucggcucccgcccuugggugagaggccugucuagccggauuuccaucuauuggaccaucgucaaacccggggauauucugaucauuaacagcaauggaaaccucaucgccccucgcggcuacuuuaagaugagaacagggaaaucuuccauuaugcggagcgacgcgcccaucggaaccuguaucucugagugcauuacaccgaauggcagcaucccuaacgacaagcccuuccagaauguuaacaaaauuaccuacggggccuguccuaaguaugugaagcagaauacgcugaaacuugcuacaggaaugcgcaacgugcccgaaaagcagaccagaggccuguuuggcgccaucgcuggguucauugagaauggaugggaaggcaugaucgaugggugguacggauuucggcaccaaaacuccgagggcaccgggcaggccgcggaccucaaaucuacacaggccgcuaucgaucaaauuaauggcaagcugaaccgcgucaucgagaaaaccaaugaaaaguuccaccagauugagaaagaguucagcgaaguggaaggaagaauccaggaccuugagaaguauguugaggauacaaagauugaccugugguccuacaacgccgaacuccugguggcucuggagaaucagcauacgaucgaucucaccgacagcgaaaugaacaaacuguuugagaagacacggagacaacuucgcgaaaacgccgaggauaugggcaaugggugcuucaaaauuuaucacaagugugacaacgccugcaucggaucuauccggaauggcaccuacgaucaugacgucuauagagacgaggcucugaacaaucgcuuucagauuaaagggguggaacucaaguccggauacaaggauuggauccuguggauuagcuucgcgaucucuugcuuucuucuguguguugugcuccugggcuucauuaugugggccugccagaaagggaacauccgguguaauaucugcauuuga

SEQ ID NO: 191558 - RNA, 1701 nt, Artificial Sequence; identical to SEQ ID NO: 183329
  derived and/or modified sequence opt5 from hemagglutinin__InfluenzaA__AFG98852

SEQ ID NO: 191559 - RNA, 1701 nt, Artificial Sequence
  derived and/or modified sequence opt5 from hemagglutinin__InfluenzaA__AFG98863
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucgacuguacccucauugaugcucugcugggcgacccccauugcgauggguuucagaaugagacgugggaccucuucgucgaacggucuaaagccuuuagcaacuguuauccuuacgaugugcccgacuaugccucccugcgcucucuuguugcuagcuccggaacccuggaguucaucaaugaaggcuuuacauggaccggcgugacacagaacgggggaagcucugccugcaagagaggcccugauuccggguucuuuagccggcucaauuggcuguacaaaucuggauccaccuaucccguccuuaacgugacgaugccuaauaacgacaauuucgauaagcuguacauuuggggcguucaccauccgagcacaaaccaagagcagaccucucucuaugugcaggcuuccgggcgcgucacagugagcaccaagagaucccagcaaaccaucauucccaacaucggaucucggccuugggugcgcggccugagcuccagaauuagcaucuacuggacaaucgucaaacccggcgacauucugguuaucaauucuaacgggaaucucauugccccucggggauacuuuaagaugcgcacgggcaaauccagcaucaugagaucugacgcgcccauugggaccuguaucagcgagugcaucacaccgaacggauccauuccuaaugauaagcccuuccagaacgugaauaaaaucaccuauggcgccuguccuaaguacgugaagcagaacacacugaaacuugcuaccgggaugcggaauguccccgaaaagcagacgcgcggacuguuuggcgccauugcuggcuucaucgagaacgggugggaaggaaugauugacggcugguauggguuuagacaccaaaauucugagggaacaggccaggccgcggaucucaaaagcacccaggccgcuaucgaccaaaucaacgggaagcugaaucgggugauugagaaaaccaacgaaaaguuccaccagaucgagaaagaguucuccgaaguugaaggccgcauucaggaucuugagaaguacguggaggacacaaagaucgaucuguggagcuauaaugccgaacuccuggucgcucuggagaaccagcauaccauugaccucacagauucugaaaugaacaaacuguuugagaagacgagacggcaacuuagagaaaaugccgaggacaugggaaacggcugcuuccgcaucuaccacaaaugugauaaugccugcauuggguccauccggaacggaaccuaugaccaugacguguacagagaugaggcucugaauaaccgcuuucagaucaagggcguugaacucaaaagcggguacaaggacuggauucuguggaucucuuucgcgauuuccugcuuucuucugugugugguccuccugggauucaucaugugggccugccagaagggcaauauucgguguaacaucugcaucuga

SEQ ID NO: 191560 - RNA, 1701 nt, Artificial Sequence
  derived and/or modified sequence opt5 from hemagglutinin__InfluenzaA__AFG98874
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauaacggguuuuucucucggcugaauuggcucuacaaauccggaagcaccuaucccguccugaacgugacgaugccuaauaacgacaacuuugauaaacuuuacauuuggggcguucaccauccgucuacagaccaagagcagaccucccuguaugugcaggcuagcgggcgcgucacagugucuaccaagagaucccagcaaaccaucauucccaauaucggaagccggccuugggugcgcggccucuccucuagaauuagcaucuacuggacaaucgucaagcccggcgacauucugguuaucaacuccaaugggaaccugauugccccucggggauacuucaagaugcgcacgggcaaaagcucuaucaugagauccgaugcgcccauugggaccuguaucagcgagugcaucacaccgaauggaucuauuccuaacgacaagcccuuucagaaugugaacaaaaucaccuauggcgccuguccuaaguacgugaagcagaauacacucaaacuggcuaccgggaugcggaacguccccgaaaagcagacgcgcggacuuuucggcgccauugcuggcuuuaucgagaaugggugggaaggaaugauugauggcugguauggguucagacaccaaaacagcgagggaacaggccaggccgcggaccugaaauccacccaggccgcuaucgaucaaaucaaugggaagcucaaccgggugauugagaaaaccaaugaaaaguuccaccagaucgagaaagaauuuucugagguugaaggccgcauucaggaccuggagaaguacguggaggauacaaagaucgaccuuuggagcuauaacgccgaacugcucgucgcucuggagaaccagcauaccauugaucugacagacuccgaaaugaauaaacucuucgagaagacgagacggcaacugagagaaaacgccgaggauaugggaaauggcugcuuuaaaaucuaccacaagugugacaacgccugcauugggagcauccgcaauggaaccuaugaccaugauguguaccgggacgaggcucuuaacaauagauuccagaucaaaggcguugaacugaagucuggguacaaggauuggauucucuggaucuccuuugcgauuagcugcuuccugcuuugugugguccugcucggauuuaucaugugggccugccagaaaggcaacauucgcuguaauaucugcaucuga

SEQ ID NO: 191561 - RNA, 1701 nt, Artificial Sequence
  derived and/or modified sequence opt5 from hemagglutinin__InfluenzaA__AFG98885
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcaccgauucuggguuuuucucccggcugaacuggcucuacaaaagcggaucuacguauccuguccugaaugugacaaugcccaacaaugacaacuuugauaaacuuuacauuuggggcguucaccauccuuccaccgaccaagagcagacaagccuguaugugcaggcuucugggcgcgucaccguguccaccaagagaagccagcaaacaaucauuccgaacaucggaucccggcccugggugcgcggccucucuagcagaauuuccaucuacuggacgaucgucaagccuggcgacauucugguuaucaauagcaacgggaaucugauugcgccccggggauacuucaagaugcgcaccggcaaaucuuccaucaugagaagcgaugccccuauugggacauguaucucugagugcaucacccccaacggaagcauuccgaaugacaagccuuuucagaacgugaauaaaaucacauauggcgccugucccaaguacgugaagcagaacacccucaaacuggcuacggggaugcggaaugucccugaaaagcagacacgcggacuuuucggcgccauugcuggcuuuaucgagaacgggugggaaggaaugauugauggcugguauggguucagacaccaaaauuccgagggaaccggccaggccgcggaccugaaaucuacccaggccgcuaucgaucaaaucaacgggaagcucaaucgggugauugagaaaacaaacgaaaaguuccaccagaucgagaaagaauuuagcgagguugaaggccgcauucaggaccuggagaaguacguggaggauaccaagaucgaccuuugguccuauaaugccgaacugcucgucgcucuggagaaccagcauacaauugaucugacggacagcgaaaugaacaaacucuucgagaagaccagacggcaacugagagaaaaugccgaggauaugggaaacggcugcuuuaaaaucuaccacaagugugacaaugccugcauugggucuauccgcaacggaacauaugaccaugauguguaccgggacgaggcucuuaauaacagauuccagaucaaaggcguugaacugaaguccggguacaaggauuggauucucuggaucagcuuugcgauuucuugcuuccugcuuugugugguccugcucggauuuaucaugugggccugccagaaaggcaauauucgcuguaacaucugcaucuga

SEQ ID NO: 191562 - RNA, 1701 nt, Artificial Sequence
  derived and/or modified sequence opt5 from hemagglutinin__InfluenzaA__AFG98896
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucaauuguacccugauugacgcucuccugggcgauccccauugcgacggguuccagaacgagacgugggaucuguuugucgaacggucuaaagccuucagcaauuguuauccuuacgacgugcccgauuaugccucccuccgcucucugguugcuagcuccggaacccuugaguuuaucaacgaaggcuucacauggaccggcgugacacagaaugggggaagcaacgccugcaagagaggcccugacucuggguuuuucucccggcugaauuggcucuacaaaagcggaucugcuuaucccguccugaacgugaccaugccuaauaacgauaacuuugacaaacuuuacauuuggggcguucaccauccguccacggaucaagagcagacaaaucuguaugugcagaccagcgggcgcgucacagugucuaccaagagaucccagcaaaccaucauucccaacaucggaagccggccuugggugcgcggccucuccucuagaauuagcaucuacuggacaaucgucaagcccggcgacauucugguuaucaauuccaacgggaaucugauugccccucggggauacuucaagaugcgcacgggcaaaagcucuaucaugagauccgacgcgcccauugggaccuguaucagcgagugcaucacaccgaacggaucuauuccuaaugauaagcccuuucagaacgugaauaaaaucaccuauggcgccuguccuaaguacgugaagcagaacacacucaaacuggcuaccgggaugcggaauguccccgaaaagcagacgcgcggaauuuucggcgccaucgcuggcuuuauugagaacgggugggaaggaaugaucgacggcugguauggguucagacaccaaaauagcgagggaacaggccaggccgcggaucuuaaauccacccaggccgcuaucgaccaaauuaacgggaagcugaaucgggugaucgagaaaaccaacgaaaaguuccaccagauugagaaagaauuuucugagguugaaggccgcauccaggaucucgagaaguacguggaggacacaaagauugaucuguggagcuauaacgccgaacuucuggucgcucucgagaaucagcauaccaucgaccugacagauuccgaaaugaacaaacuguucgagaagacgagacggcaacucagagaaaaugccgaggacaugggaaacggcugcuuuaaaauuuaccacaagugugauaaugccugcaucgggagcauccgcaacggaaccuaugaccaugacguguaccgggaugaggcucugaauaacagauuccagauuaaaggcguugaacuuaagucuggguacaaggacuggauccuguggauuuccuuugcgaucagcugcuuccuccugugugugguccuucugggauuuauuaugugggccugccagaaaggcaauauccgcuguaacaucugcauuuga

SEQ ID NO: 191563 - RNA, 1701 nt, Artificial Sequence
  derived and/or modified sequence opt5 from hemagglutinin__InfluenzaA__AFG98907
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucaauuguacccucauugacgcucugcugggcgauccccauugcgacggguuucagaacgagaaaugggaucucuucgucgaacggucuaaggccuuuagcaauuguuauccuuacgacgugcccgauuaugccucccugcgcucucuuguugcuagcuccggaacgcuggaguucaucaacgaaggcuuuaauuggaccggcgugacacagaacgggggaagcaaugccugcaaaagaggcccugacuguggguucuuuucucggcucaacuggcuguacaaguccggaagcaccuaucccguccuuaaugugacaaugccuaacaacgauaauuucgacaagcuguacauuuggggcguucaccauccgucuaccgaucaagagcagacgaaccucuaugugcaggcuuccgggcgcgucacagugagcaccaaaagaucucagcaaacaaucauucccaauaucggaucccggccuugggugcgcggccugagcuccagaauuucuaucuacuggaccaucgucaagcccggcgacauucugguuaucaacagcaaugggaaccucauugccccucggggauacuuuaaaaugcgcaccggcaaguccagcaucaugagaucugacgcgcccauugggacaugcaucuccgaguguaucacgccgaauggaagcauuccuaacgauaaacccuuccagaaugugaacaagaucaccuauggcgccugcccuaaguacgugaaacagaauacacugaagcuggcuaccgggaugcggaacguccccgaaaaacagacacgcggaauuuuuggcgccaucgcuggcuucauugagaaugggugggaaggaaugaucgacggcugguauggguuuagacaccaaaacucugagggaaccggccaggccgcggaucuuaagagcacgcaggccgcuaucgaccaaauuaaugggaaacucaaccgggugaucgagaagacaaacgaaaaauuccaccagauugagaaggaguucuccgaaguugaaggccgcauccaggaucuggagaaguacguggaggacaccaaaauugaucuuuggucuuauaaugccgaacugcucgucgcucuggagaaccagcauaccaucgaccugacagauagcgaaaugaauaagcucuuugagaaaaccagacggcaacugagagaaaacgccgaggacaugggaaauggcuguuucaagauuuaccacaaaugcgauaacgccugcaucggguccauccgcaauggaacauauaaccaugacguguaccgggacgaggcucuuaauaacagauuucagauuaagggcguugaacucaagagcggguacaaagauuggauccuguggauuucuuucgcgaucuccuguuuucugcuuugcgugguccugcucggauucauuaugugggccugucagaagggcaauauccgcugcaacaucuguauuuga

SEQ ID NO: 191564 - RNA, 1701 nt, Artificial Sequence
  derived and/or modified sequence opt5 from hemagglutinin__InfluenzaA__AFG98918
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucaauuguacccucauugacgcucugcugggcgauccccauugcgacggguuucagaacgagaaaugggaucucuucgucgaacggucuaaggccuuuagcaauuguuauccuuacgacgugcccgauuaugccucccugcgcucucuuguugcuagcuccggaacgcuggaguucaucaacgaaggcuuuaauuggaccggcgugacacagaacgggggaagcaaugccugcaaaagaggcccugaccggggguucuuuucucgccucaacuggcuguacaaguccggaagcaccuaucccguccuuaaugugacaaugccuaacaacgauaauuucgacaagcuguacauuuggggcguucaccauccgucuaccgaucaagagcagacgaaccucuaugugcaggcuuccgggagagucacagugagcaccaaacggucucagcaaacaaucauucccaauaucggaucccgcccuugggugagaggccugagcucccggauuucuaucuacuggaccaucgucaagcccggcgacauucugguuaucaacagcaaugggaaccucauugccccucgcggauacuuuaaaaugagaaccggcaaguccagcaucaugcggucugacgcgcccauugggacauguaucuccgagugcaucacgccgaauggaagcauuccuaacgauaaacccuuccagaaugugaacaagaucaccuauggcgccuguccuaaguacgugaaacagaauacacugaagcuggcuaccgggaugcgcaacguccccgaaaaacagacaagaggaauuuuuggcgccaucgcuggcuucauugagaaugggugggaaggaaugaucgacggcugguauggguuucggcaccaaaacucugagggaaccggccaggccgcggaucuuaagagcacgcaggccgcuaucgaccaaauuaaugggaaacucaaccgcgugaucgagaagacaaacgaaaaauuccaccagauugagaaggaguucuccgaaguugaaggcagaauccaggaucuggagaaguacguggaggacaccaaaauugaucuuuggucuuauaaugccgaacugcucgucgcucuggagaaccagcauaccaucgaccugacagauagcgaaaugaauaagcucuuugagaaaacccggagacaacugcgcgaaaacgccgaggacaugggaaauggcugcuucaagauuuaccacaaaugugauaacgccugcaucggguccauccggaauggaacauauaaccaugacguguacagagacgaggcucuuaauaaccgcuuucagauuaagggcguugaacucaagagcggguacaaagauuggauccuguggauuucuuucgcgaucuccugcuuucugcuuugugugguccugcucggauucauuaugugggccugccagaagggcaauauccgguguaacaucugcauuuga

SEQ ID NO: 191565 - RNA, 1701 nt, Artificial Sequence
  derived and/or modified sequence opt5 from hemagglutinin__InfluenzaA__AFG98929
augaagaccgugaucgcccugagcuacauuuucugccucguccugggccaggaccuucccgggaacgauaauuccacagcuacgcugugucucggacaccaugccguuccuaacggcacccuggugaaaacaaucaccaaugaccaaauugaggugacaaacgcgaccgaacuuguccagucuagcuccacagggaagaucugcaauaacccgcaccggauucuggauggaaucaauuguacccucaucgacgcucugcugggcgauccccauugcgacggguuucagaacgagaaaugggaucucuucguggaaagaucuaaggccuuuagcaauuguuauccuuacgacguucccgauuaugccucccugcgcucucuuguggcuagcuccggaacgcuggaguucauuaacgaaggcuuuaauuggaccggcgucacacagaacgggggaagcaaugccugcaaaagaggcccugacaucggguucuuuucucggcucaacuggcuguacaaguccggaagcaccuaucccgugcuuaauguuacaaugccuaacaacgauaauuucgacaagcuguacauuuggggcgugcaccauccgucuaccgaucaagagcagacgaaccucuauguccaggcuuccgggcgcgugacagugagcaccaaaagaucucagcaaacaaucauucccaauaucggaucccggccuuggguccgcggccugagcuccagaauuucuaucuacuggaccaucguuaagcccggcgacauucuggugaucaacagcaaugggaaccucauugccccucggggauacuuuaaaaugcgcaccggcaaguccagcaucaugagaucugacgcgcccauugggacauguaucuccgagugcaucacgccgaauggaagcauuccuaacgauaaacccuuccagaaugugaacaagaucaccuauggcgccuguccuaaguacgucaaacagaauacacugaagcuggcuaccgggaugcggaacgugcccgaaaaacagacacgcggaauuuuuggcgccaucgcuggcuucauugagaaugggugggaaggaaugaucgacggcugguauggguuuagacaccaaaacucugagggaaccggccaggccgcggaucuuaagagcacgcaggccgcuaucgaccaaauuaaugggaaacucaaccggguuaucgagaagacaaacgaaaaauuccaccagauugagaaggaguucuccgaaguggaaggccgcauccaggaucuggagaaguacgucgaggacaccaaaauugaucuuuggucuuauaaugccgaacugcucguggcucuggagaaccagcauaccaucgaccugacagauagcgaaaugaauaagcucuuugagaaaaccagacggcaacugagagaaaacgccgaggacaugggaaauggcugcuucaagauuuaccacaaaugugauaacgccugcaucggguccauccgcaauggaacauauaaccaugacguuuaccgggacgaggcucuuaauaacagauuucagauuaagggcguggaacucaagagcggguacaaagauuggauccuguggauuucuuucgcgaucuccugcuuucugcuuugugucgugcugcucggauucauuaugugggccugccagaagggcaauauccgcuguaacaucugcauuuga

SEQ ID NO: 191566 - RNA, 1701 nt, Artificial Sequence
  derived and/or modified sequence opt5 from hemagglutinin__InfluenzaA__AFG98940
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucaauuguacccucauugacgcucugcugggcgauccccauugcgacggguuucagaacgagaaaugggaucucuucgucgaacggucuaaggccuuuagcaauuguuauccuuacgacgugcccgauuaugccucccugcgcucucuuguugcuagcuccggaacgcuggaguucaucaacgaaggcuuuaauuggaccggcgugacacagaacgggggaagcaaugccugcaaaagaggcccugacucuggguucuuuucccggcucaacuggcuguacaagagcggaucuaccuaucccguccuuaaugugacaaugccuaacaaggauaacuucgacaaacuguacauuuggggcguucaccauccguccaccgaucaagagcagacgaaucucuaugugcaggcuagcgggcgcgucacagugucuaccaagagaucccagcaaacaaucauucccaacaucggaagccggccuugggugcgcggcauguccucuagaauuagcaucuacuggaccaucgucaaacccggcgacauucugguuaucaauuccaacgggaaucugauugccccucggggauacuuuaagaugcgcaccggcagaagcucuaucaugcgguccgacgcgcccauugggacauguaucagcgagugcaucacgccgaacggaucuauuccuaaugaucgccccuuccagaacgugaauaaaaucaccuauggcgccuguccuaaguacgugaagcagaacacacucaaacuggcuaccgggaugagaaauguccccgaaaagcagacacggggaauuuuuggcgccaucgcuggcuucauugagaacgggugggaaggaaugaucgacggcugguauggguuucgccaccaaaauagcgagggaaccggccaggccgcggaucuuaaauccacgcaggccgcuaucgaccaaauuaacgggaagcugaauagagugaucgagaaaacaaacgaaaaguuccaccagauugagaaagaguucucugaaguugaaggccggauccaggaucucgagaaguacguggaggacaccaagauugaucuguggagcuauaacgccgaacuucuggucgcucucgagaaucagcauaccaucgaccugacagauuccgaaaugaacaaacuguuugagaagaccagacgccaacuccgggaaaaugccgaggacaugggaaacggcugcuucaaaauuuaccacaagugugauaaugccugcaucgagagcaucagaaacgggacauauaaucaugacguguaccgcgacgaagcucugaacaaucgguuucagauuaaaggaguugagcuuaagucuggcuacaaggauuggauccuguggauuuccuucgcgaucagcugcuuucuccugugugugguccuucugggguucauuaugugggccugccagaaaggaaacaucagauguaauaucugcauuuga

SEQ ID NO: 191567 - RNA, 1701 nt, Artificial Sequence
  derived and/or modified sequence opt5 from hemagglutinin__InfluenzaA__AFG98962
augaagaccaucauugcccugagcuacaucuucugccucgugcuggcucaggaccuucccggcaacgauaauuccacagccacgcugugucucgggcaccaugcggucccuaacggaacccugguuaaaacaauuaccaaugaccaaaucgaggugacaaacgcuaccgaacuugugcagucuagcuccacaggcaagauuugcaauaacccgcacagaauccuggaugggaucaauuguacccucauugacgcccugcugggagauccccauugcgacggcuuucagaacgagaaaugggaucucuucgucgaacggucuaaggccuuuagcaauuguuauccuuacgacgugcccgauuaugcuucccugcgcucucuuguugccagcuccgggacgcuggaguucaucaacgaaggauuuaauuggaccggcgugacacagaacggcgggagcaaugcuugcaaaagaggaccugacucuggcuucuuuucccggcucaacuggcuguacaagagcgggucuaccuaucccguccuuaaugugacaaugccuaacaacgauaauuucgacaagcuguacauuuggggaguucaccauccguccaccgaucaagagcagacgaaccucuaugugcaggccagcggccgcgucacagugucuaccaaaagaucccagcaaacaaucauucccaauguggggagccggccuuggguccgcggacuguccucuagaaucagcauuuacuggaccaucguuaagcccggcgacauccuggugauuaacuccaauggcaaccucaucgcgccucggggguacuuuaaaaugcgcaccggaaagagcucuauuaugagauccgacgcccccaucggcacauguagcucugagugcauuacgccgaaugggagcaucccuaacgauaaacccuuccagaaugugaacaagaucaccuauggagcuuguccuaaguacgucaaacagaauacacugaaacuugccaccggcaugcggaacgugcccgaaaagcagacacgcgggauuuuuggagcuaucgccggcuucauugagaauggcugggaagggaugaucgacggaugguauggcuuuagacaccaaaacuccgaggggaccggacaggcggccgaucugaagucuacgcaggcugccauugaccaaaucaauggcaaacucaaccggguuaucgagaagacaaacgaaaaauuccaccagauugagaaggaguucagcgaaguggaagggcgcauccaggaucuggagaaguacgucgaggacaccaaaauugaucuuugguccuauaaugcugaacugcucguggcccuggagaaccagcauaccaucgaccugacagauagcgaaaugaauaagcucuuugagaaaaccagacggcaacugagagaaaacgccgaggacaugggcaauggaugcuucaagauuuaccacaaaugugauaacgcuugcaucggcucuauucgcaaugggacauaugaccaugacguuuaccgggaugaggcgcuuaacaauagauuucagaucaagggaguggaacugaaguccggcuacaaagacuggauccucuggauuagcuucgccaucucuugcuuucugcuuugugucgugcugcucggguucauuaugugggcuugccagaagggaaacauccgcuguaauauuugcaucuga

SEQ ID NO: 191568 - RNA, 1701 nt, Artificial Sequence
  derived and/or modified sequence opt5 from hemagglutinin__InfluenzaA__AFG98973
augaagaccaucauugcccugagcuacaucuucugccucgugcugggccaggacuuucccagaaacgauaauuccacagcuacgcuuugucuggggcaccaugccgucccuaacggaacccucguuaaaacaauuaccaaugaccaaaucgaggugacaaacgcgaaugaacuggugcagucuagcuccaccggcaagauuugcaacaauccgcaccggauccuugaugggauggacuguacacugaucgaugcucuccugggagacccccauugcgauggccugcagaacgagaccugggaccucuucgucgaacgcucuaaagccuuuagcaauuguuauccuuacgaugugcccgacuaugccucccugagaucucuuguugcuagcuccgggacgcuggaguucauuaacgaaggauuuaccuggacaggcgugacccagaauggcgggagcaacgccugcaagcggggaccugaucgcggcuucuuuucuagacucaauuggcuguacaaauccgggaacacauaucccguccuuaaugugaccaugccuaacaacgacaauuucgauaagcuguacaucuggggaguucaccauccgagcacggaccaagaccagacaucucucuaugugcaggcuuccggccgggucaccgugagcacaaagcgcucucagcaaaccgugauucccaacaucgggccuagacccuggguccggggacuguccagcggcauuuccaucuacuggaccauuguuaaaccuggcgauauccugcucaucaauucuaacgggaaucugauugcgccccgcggauacuuuaagaugagaacaggcaaaagcuccaucaugcggagcgacgccccgauugggacguguaucucugagugcauuaccccuaacggauccauccccaaugauaagccuuuccagaacgugaauaaaaucacauauggcgccugucccaaguacgugaagcagaacacccuuaaacuggcuacagggaugcgcaauguccccgagaagcagaccagaggaauuuuuggcgccaucgcuggcuucauugaaaacgggugggagggaaugaucgacggcugguauggguuucggcaccaaaauagcgaaggaacgggccaggccgcggaucucaaaucuacacaggccgcuauugaccaaaucaacgggaagcugaaucgcgugaucgagaaaaccaacgagaaguuccaccagauugaaaaagaguucagcgaaguugagggcagaauccaggaucuugaaaaguacguggaggacaccaagauugaucugugguccuauaacgccgagcuccuggucgcucuggaaaaucagcauacaaucgaccucaccgauucugagaugaacaaacuguuugaaaagacacggagacaacuucgcgagaaugccgaagacaugggaaacggcugcuucaaaauuuaccaccggugugacaaugccugcaucgggagcauuagaaacggaacguaugaucaugacguguaccgcgaugaggcucugaauaaccgguuucagaucaagggcguugagcucaaauccggguacaaggacuggauccuguggauuagcuucgcgaucucuugcuuucuucugugugugguccuccugggauucauuaugugggccugccagaagggcaauaucagauguaacauuugcaucuga

SEQ ID NO: 191569 - RNA, 1701 nt, Artificial Sequence
  derived and/or modified sequence opt5 from hemagglutinin__InfluenzaA__AFG98984
augaagaccaucauugcccugagcuacaucuucugccucgugcugggccaggacuuucccagaaacgauaauuccacagcuacgcuuugucuggggcaccaugccgucccuaacggaacccucguuaaaacaauuaccaaugaccaaaucgaggugacaaacgcgaccgaacuggugcagucuagcuccacaggcaagauuugcaauaacccgcaccggauccuugaugggauggacuguacccugaucgaugcucuccugggagacccccauugcgauggccugcagaaugagacgugggaccucuucgucgaacgcucuaaagccuuuagcaacuguuauccuuacgaugugcccgacuaugccucccugagaucucuuguugcuagcuccgggacccuggaguucauuaaugaaggauuuacauggaccggcgugacacagaacggcgggagcaaugccugcaagcggggaccugaucgcggcuucuuuucuagacucaacuggcuguacaaauccgggaauaccuaucccguccuuaacgugacgaugccuaauaacgacaacuucgauaagcuguacaucuggggaguucaccauccgagcacagaccaagaccagaccucucucuaugugcaggcuuccggccgggucacagugagcaccaagcgcucucagcaaaccgugauucccaauaucgggccuagacccuggguccggggacuguccagcggcauuuccaucuacuggacaauuguuaaaccuggcgauauccugcucaucaacucuaaugggaaccugauugcgccccgcggauacuuuaagaugagaacgggcaaaagcuccaucaugcggagcgacgccccgauugggaccuguaucucugagugcauuacaccuaauggauccauccccaacgauaagccuuuccagaaugugaacaaaaucaccuauggcgccugucccaaguacgugaagcagaauacacuuaaacuggcuaccgggaugcgcaacguccccgagaagcagacgagaggaauuuuuggcgccaucgcuggcuucauugaaaaugggugggagggaaugaucgacggcugguauggguuucggcaccaaaacagcgaaggaacaggccaggccgcggaucucaaaucuacccaggccgcuauugaccaaaucaaugggaagcugaaccgcgugaucgagaaaaccaaugagaaguuccaccagauugaaaaagaguucagcgaaguugagggcagaauccaggaucuugaaaaguacguggaggacacaaagauugaucugugguccuauaacgccgagcuccuggucgcucuggaaaaccagcauaccaucgaccucacagauucugagaugaauaaacuguuugaaaagacgcggagacaacuucgcgagaacgccgaagacaugggaaauggcugcuucaaaauuuaccaccggugugacaacgccugcaucgggagcauuagaaauggaaccuaugaucaugacguguaccgcgaugaggcucugaacaaucgguuucagaucaagggcguugagcucaaauccggguacaaggacuggauccuguggauuagcuucgcgaucucuugcuuucuucugugugugguccuccugggauucauuaugugggccugccagaagggcaacaucagauguaauauuugcaucuga

SEQ ID NO: 191570 - RNA, 1704 nt, Artificial Sequence
  derived and/or modified sequence opt5 from hemagglutinin__InfluenzaA__AFG98995
augaagaccaucauugcccugagcuacaucuucugccucguguuugcucaggaccugcccggcaacgauaauaacuccacagccacgcuuugucuggggcaccaugcggucccuaauggaacccucguuaaaacaauuaccaacgaccaaaucgaggugacaaaugcuaccgaacuggugcagucuagcuccacaggcaagauuugcaacaauccgcacagaauccuugaugggaucaacuguacccugauugacgcccuccugggagauccccauugcgacggcuuccagaaugagaaaugggaucuguuugucgaacggucuaaggccuucagcaacuguuauccuuacgacgugcccgauuaugcuucccuccgcucucugguugccagcuccgggacgcuugaguuuaucaaugaaggauucaacuggaccggcgugacacagaauggcgggagcaacgcuugcaaaagaggaccugacauuggcuuuuucucucggcugaauuggcucuacaaguccgggagcaccuaucccguccaaaacgugacaaugccuaacaaugauaacucugacaagcuguacaucuggggaguucaccauccguccaccgauaaagagcagacggaccuuuaugugcaggccagcggcaaggucacagugucuaccaaacgcucccagcaaacaauuauccccaauguggggagcagaccuuggguccggggacuguccucucgcauuagcaucuacuggaccaucguuaagcccggcgacauucucgugaucaacuccaauggcaaccugauugcgccuagaggguacuuuaaaaugcggaccggaaagagcucuaucaugcgcuccgaugcccccauuggcacauguagcucugagugcaucacgccgaaugggagcaucccuaacgacaagcccuuccagaaugugaacaaaauuaccuauggagcuuguccuaaguacgucaaacagaauacacugaagcucgccaccggcaugagaaacgugcccgaaaaacagacacgggggaucuuuggagcuauugccggcuucaucgagaauggcugggaagggaugauugauggaugguauggcuuucgccaccaaaacuccgaggggaccggacaggcggccgaccugaagucuacgcaggcugccaucgaucaaaucaauggcaaacuuaacagaguuauugagaagacaaacgaaaaguuccaccagaucgagaaagaguucagcgaaguggaagggcggauucaggaccuggagaaguacgucgaggauaccaaaaucgaccucugguccuauaaugcugaacugcuuguggcccuggagaaccagcauaccauugaucucacagacagcgaaaugaauaagcuguuugagaaaacccgcagacaacugcgggaaaacgccgaggauaugggcaauggaugcuucaagaucuaccacaagugugacaacgcuugcauuggcucuaucagaaaugggacauaugaccaugauguuuaccgcgacgaggcgcucaacaaucgguuucagaucaaaggaguggaacugaaguccggcuacaaagauuggauucuuuggaucagcuucgccauuucuugcuuucugcucugugucgugcugcuuggguucaucaugugggcuugccagaagggaaacauuagauguaauaucugcaucuga

SEQ ID NO: 191571 - RNA, 1701 nt, Artificial Sequence
  derived and/or modified sequence opt5 from hemagglutinin__InfluenzaA__AFG99006
augaagaccaucauugcccugagcuacaucuucugccucgugcugggccaggacuuucccagaaacgauaauuccacagcuacgcuuugucuggggcaccaugccgucccuaacggaacccucguuaaaacaauuaccaaugaccaaaucgaggugacaaacgcgaccgaacuggugcagucuagcuccacaggcaagauuugcaauaacccgcaccggauccuugaugggauggacuguacccugaucgaugcucuccugggagacccccauugcgauggccugcagaaugagacgugggaccucuucgucgaacgcucuaaagccuuuagcaacuguuauccuuacgaugugcccgacuaugccucccugagaucucuuguugcuagcuccgggacccuggaguucauuaaugaaggauuuacauggaccggcgugacacagaacggcgggagcaaugccugcaagcggggaccugaucgcggcuucuuuucuagacucaacuggcuguacaaauccgggaauaccuaucccguccuuaacgugacgaugccuaauaacgacaacuucgauaagcuguacaucuggggaguucaccauccgagcacagaccaagaccagaccucucucuaugugcaggcuuccggccgggucacagugagcaccaagcgcucucagcaaaccgugauucccaauaucgggccuagacccuggguccggggacuguccagccgcauuuccaucuacuggacaauuguuaaaccuggcgauauccugcucaucaacucuaauggcaaccugauugcccccagaggguacuuuaagaugcggacgggaaaaagcuccaucaugcgcagcgacgcgccgauuggcaccuguaucucugagugcauuacaccuaauggguccauccccaacgauaagccuuuccagaaugugaacaaaaucaccuauggagccugucccaaguacgugaagcagaauacacuuaaacuggcuaccggcaugagaaacguccccgagaagcagacgcgggggauuuuuggagccaucgcuggcuucauugaaaauggcugggaggggaugaucgacggaugguauggcuuucgccaccaaaacagcgaagggacaggacaggccgcggaucucaaaucuacccaggccgcuauugaccaaaucaauggcaagcugaacagagugaucgagaaaaccaaugagaaguuccaccagauugaaaaagaguucagcgaaguugaggggcggauccaggaucuugaaaaguacguggaggacacaaagauugaucugugguccuauaacgccgagcuccuggucgcucuggaaaaccagcauaccaucgaccucacagauucugagaugaauaaacuguuugaaaagacgagacgccaacuucgggagaacgccgaagacaugggcaauggaugcuucaaaauuuaccacagaugugacaacgccugcaucggcagcauucgcaaugggaccuaugaucaugacguguaccgggaugaggcucugaacaauagauuucagaucaagggaguugagcucaaauccggcuacaaggacuggauccuguggauuagcuucgcgaucucuugcuuucuucugugugugguccuccugggguucauuaugugggccugccagaagggaaacauccgcuguaauauuugcaucuga

SEQ ID NO: 191572 - RNA, 1701 nt, Artificial Sequence; identical to SEQ ID NO: 183788
  derived and/or modified sequence opt5 from hemagglutinin__InfluenzaA__AFG99017

SEQ ID NO: 191573 - RNA, 1701 nt, Artificial Sequence
  derived and/or modified sequence opt5 from hemagglutinin__InfluenzaA__AFG99028
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgggaauccgcacagaauccuugauggaaucaacuguacccugauugacgcccuccugggcgauccccauugcgacggguuccagaaugagaaaugggaucuguuugucgaacggucuaaggccuucagcaacuguuauccuuacgacgugcccgauuaugcuucccuccgcucucugguugccagcuccggaacgcuugaguuuaucaaugaaggcuucaacuggaccggcgugacacagaaugggggaagcucugcuugcaaaagaggcccugacaacggguuuuucucccggcugaauuggcucuacaagagcggaucuaccuaucccguccaaaacgugacaaugccuaauaacgauaacuccgacaagcuguacauuuggggcguucaccauccgagcaccgauaaagagcagacggaccuuuaugugcaggccucugggaaggucacaguguccaccaaacgcagccagcaaacagugauccccaaugucggauccagaccuuggguucggggccugucuagccgcguguccauuuacuggaccaucgugaagcccggcgacauucucgucaucaacagcaaugggaaccugaucgcgccuagaggauacuuuaaaaugcggaccggcaagucuuccauuaugcgcagcgaugcccccaucgggacauguucuagcgagugcauuacgccgaauggauccaucccuaacgacaagcccuuccagaaugugaacaaaauuaccuauggcgcuuguccuaaguacguuaaacagaauacacugaagcucgccaccgggaugagaaacgugcccgaaaaacagacacggggaaucuuuggcgcuaucgccggcuucauugagaaugggugggaaggaaugaucgauggcugguauggguuucgccaccaaaacucugagggaaccggccaggcggccgaccuuaagagcacgcaggcugccauugaucaaaucaaugggaaacugaacagagucauugagaagacaaaugaaaaguuccaccagaucgagaaagaguucuccgaaguggaaggccggauccaggaccuggagaaguacguugaggauaccaaaauugaccucuggagcuauaacgcugaacugcuuguggcccuggagaaccagcauaccaucgaucucacagacucugaaaugaauaagcuguuugagaaaacccgcagacaacugcgggaaaacgccgaggauaugggaaauggcugcuucaagauuuaccacaagugugacaacgcuugcaucggguccauuagaaauggaacauaugaccaugaugucuaccgcgacgaggcgcucaacaaucgguuucagaucaaaggcguggaacuuaagagcggguacaaagauuggauucuguggaucucuuucgccaucuccugcuuucugcucugugucgugcugcuuggauucauuaugugggcuugccagaagggcaacaucagauguaauauuugcaucuga

SEQ ID NO: 191574 - RNA, 1701 nt, Artificial Sequence
  derived and/or modified sequence opt5 from hemagglutinin__InfluenzaA__AFG99039
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacguggccaugccuaauaacgacaacuccgauaagcuguacauuuggggaguucaccauccgagcacagacaaagagcagaccgaccuuuaugugcaggcgucuggcaaggucacgguguccacaaaacgcagccagcaaaccgugauccccaaugucggguccagaccuuggguucggggacugucuagccgcguguccauuuacuggacaaucgugaagcccggcgauauucucgucaucaacagcaauggcaaccugaucgccccuagaggguacuuuaaaaugcggaccggaaagucuuccauuaugcgcagcgacgcucccaucggcaccuguucuagcgagugcauuacaccgaauggguccaucccuaacgauaagcccuuccagaaugugaacaaaauuacguauggagccuguccuaaguacguuaaacagaauacccugaagcucgcuacaggcaugagaaacgugcccgaaaaacagacccgggggaucuuuggagccaucgcgggcuucauugagaauggcugggaagggaugaucgacggaugguauggcuuucgccaccaaaacucugaggggacaggacaggccgcugaucuuaagagcacccaggccgcuauugaccaaaucaauggcaaacugaacagagucauugagaagacgaaugaaaaguuccaccagaucgagaaagaguucuccgaaguggaagggcggauccaggaucuggagaaguacguugaggacacaaaaauugaucucuggagcuauaacgccgaacugcuuguggcccuggagaaccagcauaccaucgaccucaccgauucugaaaugaauaagcuguuugagaaaacacgcagacaacugcgggaaaacgcugaggacaugggcaauggaugcuucaagauuuaccacaagugugacaacgcgugcaucggcuccauuagaaaugggaccuaugaucaugacgucuaccgcgaugaggcccucaacaaucgguuucagaucaaaggaguggaacuuaagagcggcuacaaagacuggauucuguggaucucuuucgcuaucuccugcuuucugcucugugucgugcugcuuggguucauuaugugggccugccagaagggaaacaucagauguaauauuugcaucuga

SEQ ID NO: 191575 - RNA, 1701 nt, Artificial Sequence; identical to SEQ ID NO: 183788
  derived and/or modified sequence opt5 from hemagglutinin__InfluenzaA__AFG99050

SEQ ID NO: 191576 - RNA, 1701 nt, Artificial Sequence
  derived and/or modified sequence opt5 from hemagglutinin__InfluenzaA__AFG99061
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacgugacaaugccuaauaacgacaacuccgauaagcuguacauuuggggaguucaccauccgagcaccgacaaagagcagacggaccuuuaugugcaggccucuggcaaggucacaguguccaccaaacgcagccagcaaacagugauccccaaugucggguccagaccuuggguucggggacugucuagccgcguguccauuuacuggaccaucgugaagcccggcgauauucucgucaucaacagcaauggcaaccugaucgcgccuagaggguacuuuaaaaugcggaccggaaagucuuccauuaugcgcagcgacgcccccaucggcacauguucuagcgagugcauuacgccgaauggguccaucccuaacgauaagcccuuccagaaugugaacaaaauuaccuauggagcuuguccuaaguacaucaaacagaauacacugaagcucgccaccggcaugagaaacguucccgaaaaacagacacgggggaucuuuggagcuauugccggcuucaucgagaauggcugggaagggaugauugacggaugguauggcuuucgccaccaaaacucugaggggaccggacaggcggccgaucuuaagagcacgcaggcugccaucgaccaaauuaauggcaaacugaacaaggugaucgagaagacaaaugaaaaauuccaccagaucgagaaggaguucuccgaagucgaagggcggauucaggaucuggagaaauacguggaggacaccaagaucgaucucuggagcuauaacgcugaacugcuuguugcccuggagaaccagcauaccauugaccucacagauucugaaaugaauaaacuguuugagaagaccagacgccaacugagagaaaacgccgaggacaugggcaauggaugcuucaagaucuaccacaaaugugacaacgcuugcauuggcuccauccggaaugggacauaugaucaugacguguacagagaugaggcgcucaacaaucgcuuucagauuaagggagucgaacugaaaagcggcuacaaggacuggauccuuuggaucucuuucgccauuuccugcuuucugcucugugugguccugcuuggguucaucaugugggcuugccagaaaggaaacauucgguguaauaucugcauuuga

SEQ ID NO: 191577 - RNA, 1701 nt, Artificial Sequence
  derived and/or modified sequence opt5 from hemagglutinin__InfluenzaA__AFG99072
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaaaaacuguacccugaucgaugcccuccugggagacccccauugcgauggcuuccagaaugagaagugggaccuguuugucgaacggucuaaagccuucagcaacuguuauccuuacgaugugcccgacuaugcuucccuccgcucucugguugccagcuccgggacgcuugaguuuauuaaugaaggauucaacuggaccggcgugacacagaauggcgggagcucugcuugcaagagaggaccugauaacggcuuuuucucccggcugaauuggcucuacaagagcgggucuaccuaucccguccaaaacgugacaaugccuaauaacgacaacuccgaucgccuguacaucuggggaguucaccauccgagcaccgacaaagagcagacggaccuuuaugugcaggccucuggcaaggucacaguguccaccaaaagaagccagcaaacagugauucccaaugucgggucccggccuuggguucgcggacugucuagcagaguguccaucuacuggaccauugugaagcccggcgauauccucgucauuaacagcaauggcaaccugaucgcgccucggggguacuuuaaaaugcgcaccggaaagucuuccaucaugagaagcgacgcccccauuggcacauguucuagcgagugcaucacgccgaauggguccauuccuaacgauaagcccuuccagaaugugaacaaaaucaccuauggagcuuguccuaaguacguuaaacagaauacacugaagcucgccaccggcaugcggaacgugcccgaaaaacagacacgcgggauuuuuggagcuaucgccggcuucaucgagaauggcugggaagggaugauugacggaugguauggcuuuagacaccaaaacucugaggggaccggacaggcggccgaucuuaagagcacgcaggcugccaucgaccaaauuaauggcaaacugaaccgggucaucgagaagacaaaugaaaaguuccaccagauugagaaagaguucuccgaaguggaagggcgcauccaggaucuggagaaguacguugaggacaccaaaaucgaucucuggagcuauaacgcugaacugcuuguggcccuggagaaccagcauaccauugaccucacagauucugaaaugaauaagcuguuugagaaaaccagacggcaacugagagaaaacgccgaggacaugggcaauggaugcuucaagaucuaccacaagugugacaacgcuugcauuggcuccauccgcaaugggacauauaaccaugaugucuaccgggacgaggcgcucaauaacagauuucagauuaaaggaguggaacuuaagagcggcuacaaagauuggauccuguggauuucuuucgccaucuccugcuuucugcucugugucgugcugcuuggguucaucaugugggcuugccagaagggaaauauucgcuguaacaucugcauuuga

SEQ ID NO: 191578 - RNA, 1701 nt, Artificial Sequence
  derived and/or modified sequence opt5 from hemagglutinin__InfluenzaA__AFG99083
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaagggcuuuuucucccggcugaacuggcucuacaagagcgggucuaccuaucccguccaaaaugugacaaugccuaacaaugacaacuccgauaaacuguacauuuggggaguucaccauccgagcaccgacaaggagcagacggaccuuuaugugcaggccucuggcaaagucacaguguccaccaagcgcagccagcaaacagugauccccaacgucggguccagaccuuggguucggggacugucuagccgcguguccauuuacuggaccaucgugaaacccggcgauauucucgucaucaauagcaacggcaaucugaucgcgccuagaggguacuuuaagaugcugaccggaaagucuuccauuaugcggagcgacgcccccaucggcacauguucuagcgagugcauuacgccgaacggguccaucccuaaugauaaacccuuccagaacgugaauaagauuaccuauggagcuuguccuaaauacguuaagcagaacacacucaaacuggccaccggcaugcgcaaugugcccgaaaagcagacaagagggaucuuuggagcuaucgccggcuucauugagaacggcugggaagggaugaucgacggaugguauggcuuucggcaccaaaauucugaggggaccggacaggcggccgaucuuaaaagcacgcaggcugccauugaccaaaucaacggcaagcugaaucgcgucauugagaagacaaacgaaaaauuccaccagaucgagaaggaguucuccgaaguggaagggagaauccaugaucucgagaaauacguugaggacaccaagauugaucuguggagcuauaaugcugaacuucugguggcccucgagaaccagcacaccaucgaccugacagauucugaaaugaacaaacuguuugagaagacccggcgccagcucagagaaaaugccgaggacaugggcaacggaugcuucaagauuuaccauaaaugugacaaugcuugcaucggcuccauucggaacgggacauaugaucacgacgucuacagagaugaggcgcugaauaaccgcuuucaaaucaagggaguggaacuuaaaagcggcuacaaggacuggauucuguggaucucuuucgccaucuccugcuuucuccugugugucgugcuucugggguucauuaugugggcuugccagaaaggaaauauccgguguaacauuugcaucuga

SEQ ID NO: 191579 - RNA, 1701 nt, Artificial Sequence
  derived and/or modified sequence opt5 from hemagglutinin__InfluenzaA__AFG99094
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcggagcuugcaaaagaggcccugauaacggguuuuucucucggcugaauuggcucuacaaguccggaagcaccuaucccguccaaaacgugacaaugccuaauaacgacaacucugauaagcuguacauuuggggcguucaccauccguccaccgacaaagagcagacggaccuuuaugugcaggccagcgggaaggucacagugucuaccaaacgcucccagcaaacagugauccccaaugucggaagcagaccuuggguucggggccuguccucucgcgugagcauuuacuggaccaucgugaagcccggcgauauucucgucaucaacuccaaugggaaccugaucgcgccuagaggauacuuuaaaaugcggaccggcaagagcucuauuaugcgcuccgacgcccccaucgggacauguagcucugagugcauuacgccgaauggaagcaucccuaacgauaagcccuuccagaaugugaacaaaauuaccuauggcgcuuguccuaaguacguuaaacagaauacacugaagcucgccaccgggaugagaaacgugcccgaaaaacagacacggggaaucuuuggcgcuaucgccggcuucauugagaaugggugggaaggaaugaucgacggcugguauggguuucgccaccaaaacuccgagggaaccggccaggcggccgaucugaagucuacgcaggcugccauugaccaaaucaaugggaaacuuaacagagucauugagaagacaaaugaaaaguuccaccagaucgagaaagaguucagcgaaguggaaggccggauccaggaucuggagaaguacguugaggacaccaaaauugaucucugguccuauaacgcugaacugcuuguggcccuggagaaccagcauaccaucgaccucacagauagcgaaaugaauaagcuguuugagaaaacccgcagacaacugcgggaaaacgccgaggacaugggaaauggcugcuucaagauuuaccacaagugugacaacgcuugcaucgggucuauuagaaauggaacauaugaucaugacgucuaccgcgaugaggcgcucaacaaucgguuucagaucaaaggcguggaacugaaguccggguacaaagacuggauucuuuggaucagcuucgccaucucuugcuuucugcucugugucgugcugcuuggauucauuaugugggcuugccagaagggcaacaucagauguaauauuugcaucuga

SEQ ID NO: 191580 - RNA, 1701 nt, Artificial Sequence
  derived and/or modified sequence opt5 from hemagglutinin__InfluenzaA__AFG99116
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccuggucgacgcccuccugggagauccccauugcgacggcuuccagaaugagaaaugggaucuguuuguggaacgcagcaaggccuucuccaacuguuauccuuacgacguucccgauuaugcuucucucagaagccugguggccuccagcgggacgcuugaguuuaucaaugaaucuuucaacuggaccggagucacacaguccggcggcagcuacgcuugcaaacgggggucugacaauuccuuuuucagccgccugaacuggcucuaugagucugaguccaaguacccugugcugaauguuaccaugcccaacaauggaaacuuugauaaacuuuauauuuggggcgugcaccauccuagcacagacaaggaacaaaccaaccuguacgucagagccuccgggcgggugacggugucuacaaagcgcagccagcagaccaucauuccgaauaucggauccagacccuggguccggggccucagcucucgcauuuccaucuacuggacaauuguuaaaccuggggauauccugcugaucaacagcaauggaaaccucauugcgcccagaggcuauuucaagauccggaccggcaaaucuagcauuaugcgcuccgacgccccuaucgggaccuguucuagcgagugcauuacacccaauggauccaucccgaacgacaagccuuuucagaaugugaacaagaucacguacggcgcuugucccaaauaugugaagcaaaauacccugaaacuugccacagggaugagaaacgucccugaaaagcagacccggggaauuuucggcgcuaucgccggguuuauugagaauggaugggagggcaugguggauggcugguacggguuccgccaccagaacagcgaaggaacaggccaggcggccgaccugaaaucuacccaagcugccaucgaucagauuaaugggaagcucaacagaguuaucgagaaaacgaaugaaaaguuccaccagaucgagaaggaauuuuccgagguggagggacggauucaagaccuggaaaaauaugucgaggauacaaagaucgaccuuuggagcuacaacgcugaacugcucguggcccuggagaaccagcauaccauugaucugaccgacucugaaaugaauaaacucuucgagaagacaagacgccagcugcgggagaacgccgaagauaugggcaaugggugcuuuaaaaucuaucacaagugugacaacgcuugcauuggcuccaucagaaauggaaccuacgaucaugacguuuaccgcgacgaggcgcuuaacaaucgguuccagauuaagggcguggaacugaaaagcggguauaaggauuggauccucuggaucuccuuugccauuucuugcuuccugcuuugugucgugcugcucggauuuaucaugugggcuugccaaaaaggcaacauuagauguaauaucugcauuuga

SEQ ID NO: 191581 - RNA, 1701 nt, Artificial Sequence
  derived and/or modified sequence opt5 from hemagglutinin__InfluenzaA__AFG99127
augaagaccaucauugcccugagcuacauccucugccugguguucgcucagaaccuucccggcaaugacaacuccacagccacgcugugucucgggcaccaugcggucccuaauggaacccugguuaaaacaauuaccaacgaucaaaucgaggugacaaaugcuaccgaacuugugcagucuagcuccacaggcagaauuugcgacucuccgcaccggauccuggaugggaagaacuguacccucgucgacgcccugcugggagauccccauugcgacggcuuucagaaugagaaaugggaucucuucguggaacgcagcaaggccuuuuccaacuguuauccuuacgacguucccgauuaugcuucucugagaagccuuguggccuccagcgggacgcuggaguucaucaaugaaucuuuuaacuggaccggagucacacaguccggcggcagcuacgcuugcaaacgggggucugacaauuccuucuuuagccgccucaacuggcuguaugagucugaguccaaguacccugugcuuaauguuaccaugcccaacaauggaaacuucgauaagcuguauauuuggggcgugcaccauccuagcacagacaaagaacaaaccaaccucuacgucagagccuccgggcgggugacggugucuacaaagcgcagccagcagaccaucauuccgaauaucggauccagacccuggguccggggccugagcucucgcauuuccaucuacuggacaauuguuaaaccuggggauauccugcucaucaacagcaauggaaaccugauugcgcccagaggcuauuuuaagauccggaccggcaaaucuagcauuaugcgcuccgacgccccuaucgggaccuguucuagcgagugcauuacacccaauggauccaucccgaacgacaagccuuuccagaaugugaacaagaucacguacggcgcuugucccaaauaugugaagcaaaauacccuuaaacuggccacagggaugagaaacgucccugaaaagcagacccggggaauuuuuggcgcuaucgccggguucauugagaauggaugggagggcaugguggauggcugguacggguuucgccaccagaacagcgaaggaacaggccaggcggccgaccucaaaucuacccaagcugccaucgaucagauuaaugggaagcugaacagaguuaucgagaaaacgaaugaaaaguuccaccagaucgagaaggaguucuccgaaguggagggacggauucaagaccuugaaaaauaugucgaggauacaaagaucgaccuguggagcuacaacgcugaacuccugguggcccuggagaaccagcauaccauugaucucaccgacucugaaaugaauaaacuguuugagaagacaagacgccagcuucgggagaacgccgaagauaugggcaaugggugcuucaaaaucuaucacaagugugacaacgcuugcauuggcuccaucagaaauggaaccuacgaucaugacguuuaccgcgacgaggcgcugaacaaucgguuucagauuaagggcguggaacucaaaagcggguauaaggauuggauccuguggaucuccuucgccauuucuugcuuucuucugugugucgugcuccugggauucaucaugugggcuugccaaaaaggcaacauuagauguaauaucugcauuuga

SEQ ID NO: 191582 - RNA, 1701 nt, Artificial Sequence
  derived and/or modified sequence opt5 from hemagglutinin__InfluenzaA__AFG99138
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccuggucgacgcccuccugggagauccccauugcgacggcuuccagaaugagaaaugggaucuguuuguggaacgcagcaaggccuucuccaacuguuauccuuacgacguucccgauuaugcuucucucagaagccugguggccuccagcgggacgcuugaguuuaucaaugaaucuuucaacuggaccggagucacacaguccggcggcagcucugcuugcaaacggggguccgacaauagcuuuuucucucgccugaacuggcucuacgaguccgagagcaaguauccugugcugaauguuaccaugcccaacaauggaaacuuugauaaacuuuacauuuggggcgugcaccauccuuccacagacaaggaacaaaccaaccuguaugucagagccucugggcgggugacggugagcacaaagcgcaaucagcagaccgucaucccgaacauuggauccagacccuggguucggggccucagcucucgcaucuccauuuacuggacaaucgugaaaccuggggauauucugcugaucaauagcaacggaaaucucaucgcgcccagaggcuacuucaagauucggaacggcaaaucuagcaucaugcgcuccgacgccccuauugggaccuguucuagcgagugcaucacccccaauggauccauuccgaacgacaagccuuuucagaaugugaacaagaucacauauggcgcuugucccaaauacgucaagcaaaauacgcugaaacuugccaccgggaugagaaacgugccugaaaagcagacacggggaaucuucggcgcuauugccggguuuaucgagaauggaugggagggcaugguugauggcugguauggguuccgccacagaaacagcgaaggaaccggccaggcggccgaccugaaaucuacacaggcugccauugaucaaaucaaugggaagcucaaccgggugauugagaaaaccaacgaaaaguuccaccagaucgagaaggaauuuuccgaggucgagggaagaauccaggaccuggaaaaauacguggaggauacgaagauugaccuuuggagcuauaaugcugaacugcucguugcccuggagaaccaacauacaaucgaucugaccgacucugaaaugaauaaacucuucgagaagacccgccggcagcugagagagaacgccgaagauaugggcaaugggugcuuuaaaauuuaccacaagugugacaacgcuugcaucggcuccauucgcaauggaacauaugaucaugacguguaccgggacgaggcgcuuaacaauagauuccagaucaagggcgucgaacugaaaagcggguacaaggauuggauucucuggaucuccuuugccaucucuugcuuccugcuuugugugguccugcucggauuuauuaugugggcuugccagaaaggcaacauccgcuguaauauuugcaucuga

SEQ ID NO: 191583 - RNA, 1701 nt, Artificial Sequence
  derived and/or modified sequence opt5 from hemagglutinin__InfluenzaA__AFG99149
augaagaccaucauugcccugagcuacauccucugccugguguucgcucagaaccuucccggcaaugacaacuccacagccacgcugugucucgggcaccaugcggucccuaauggaacccugguuaaaacaauuaccaacgaucaaaucgaggugacaaaugcuaccgaacuugugcagucuagcuccacaggcagaauuugcgacucuccgcaccggauccuggaugggaagaacuguacccucaucgacgcccugcugggagauccccauugcgacggcuuucagaaugagaaaugggaucucuucgucgaacgcagcagagccuuuuccaacuguuauccuuacgacgugcccgauuaugcuucucugcggagccuuguugccuccagcgggacgcuggaguucauuaaugaaggauuuaacuggaccggcgugacacagucuggcggguccuacgcuugcaagcgcggaagcgacaauucuuucuuuuccagacucaacuggcuguaugagagcgagucuaaauacccuguccuuaaugugaccaugcccaacaauggcaaguucgauaagcuguauaucuggggaguucaccauccuuccacagacaaagaacaaaccaaccucuacgugcgggccagcgggcgcgucacgguguccacaaagagaucucagcagaccgugauuccgaacaucggcagccggcccuggguccgcgggcuguccagcagaauuucuaucuacuggacaauuguuaaaccuggagauauccugcucaucaauuccaccggcaaccugauugcgccccggggcuauuuuaagauccgcaccgggaaaagcucuauuaugagaagcgacgccccuaucggaacauguuccucugagugcauuacgcccaauggcagcaucccgaacgacaagccuuuccagaaugugaacaagaucaccuacggggcuuguccccgguaugugaaacaaaauacacuuaagcuggccaccggaaugcgcaacgucccugaaaaacagacaagaggcauuuuuggggcuaucgccggauucauugagaauggcugggagggcaugguggaugggugguacggauuucggcaccagaacuccgaaggcaccgggcaggcggccgaccucaagagcacgcaagcugccaucgaucagauuaauggaaaacugaacagaguuaucgagaagacaaaugaaaaauuccaccagaucgagaaggaguucucugaaguggagggccgcauucaagaccuugaaaaguaugucgaggauaccaaaaucgaccugugguccuacaacgcugaacuccugguggcccuggagaaucagcauaccauugaucucacagacgccgaaaugaacaagcuguuugagaaaacccggaagcagcuuagagagaacgcugaagauauggggaauggcugcuucaaaaucuaucacaagugugacaacgcgugcauuggaagcauccgcaauggcacauacgaucaugacguuuaccgggacgaggcccugaacaauagauuucagauuaaggggguggaacucaaaucuggauauaaggauuggauccuguggaucuccuucgcuauuagcugcuuucuucugugugucgugcuccugggcuucaucaugugggccugccaaaaagggaacauucgcuguaauaucugcauuuga

SEQ ID NO: 191584 - RNA, 1701 nt, Artificial Sequence
  derived and/or modified sequence opt5 from hemagglutinin__InfluenzaA__AFG99171
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccuggucgacgcccuccugggagauccccauugcgacggcuuccagaaugagaaaugggaucuguuuguggaacgcagcaaggccuucuccaacuguuauccuuacgacguucccgauuaugcuucucucagaagccugguggccuccagcgggacgcuugaguuuaccaaugaaucuuucaacuggacaggagucacccaguccggcggcagcuacgcuugcaaacgggggucugacaauuccuuuuucagccgccugaacuggcucuaugagucugaguccaaguacccugugcugaauguuacaaugcccaacaauggaaacuuugauaaacuuuauaucuggggcgugcaccauccuagcaccgacaaggaacaaacgaaccuguacgucagagccuccgggcgggugacagugucuaccaagcgcaaucagcagacagucauuccgaacaucggaagcagacccuggguucggggccucuccagccgcauuucuaucuacuggaccauugugaaaccuggggauauccugcugauuaauuccaacggaaaucucaucgcgcccagaggcuauuucaagauccggaacggcaaaagcucuauuaugcgcagcgacgccccuaucgggaccuguuccucugagugcauuacacccaauggaagcaucccgaacgacaagccuuuucagaaugugaacaagauuacguacggcgcuugucccaaauaugucaagcaaaauacccugaaacuugccacagggaugagaaacgugccugaaaagcagacccggggaaucuucggcgcuaucgccggguuuauugagaauggaugggagggcaugguugauggcugguacggguuccgccacagaaacuccgaaggaacaggccaggcggccgaccugaaaagcacccaggcugccaucgaucaaauuaaugggaagcucaaccgggugaucgagaaaacgaacgaaaaguuccaccagauugagaaggaauuuucugaggucgagggaagaauccaggaccuggaaaaauauguggaggauacaaagaucgaccuuugguccuacaaugcugaacugcucguugcccuggagaaccaacauaccauugaucugaccgacagcgaaaugaauaaacucuucgagaagacacgccggcagcugagagagaacgccgaagauaugggcaaugggugcuuuaaaaucuaucacaagugugacaacgcuugcauuggcucuauccgcaauggaaccuacgaucaugacguguaccgggacgaggcgcuuaacaauagauuccagauuaagggcgucgaacugaaauccggguauaaggauuggauccucuggauuagcuuugccaucuccugcuuccugcuuugugugguccugcucggauuuaucaugugggcuugccagaaaggcaacauucgcuguaauaucugcauuuga

SEQ ID NO: 191585 - RNA, 1701 nt, Artificial Sequence
  derived and/or modified sequence opt5 from hemagglutinin__InfluenzaA__AFG99182
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuaugagagcgaguacaaguauccugcccugaacgugaccaugcccaauaacggcaaauuugacaaacuuuacaucuggggaguucaccauccuucuacagauaaggaacaaaccaaucuguacgugagagcguccgggcgggucacggugagcacaaagcgcucccagcagaccgugauuccgaacaucggcucuagacccuggguccgggggcucagcucccgcauuagcaucuauuggacaauuguuaaaccuggagacauccugcugaucaacucuaccggcaaucucauugcccccagaggcuacuucaagauccggaccgggaaguccagcauuaugcgcucugaugcuccuaucggaacauguagcuccgagugcauuacgcccaacggcucuaucccgaaugacaaaccuuuucagaacgugaauaagaucaccuauggggccugucccagauacgugaaacaaaacacacugaaacuugcuaccggaaugcggaaugucccugaaaagcagacacgcggcauuuucggggccaucgcgggauuuauugagaacggcugggagggcaugguggacgggugguauggauucagacaccagaauagcgaaggcaccgggcaggccgcugaucugaaguccacgcaagccgcuaucgaccagauuaacggaaaacucaaucggcugaucgagaagacaaacgaaaaguuccaccagaucgagaaagaauuuagcgagguugagggccgcauucaagaucuugaaaaguacguggaggacaccaaaaucgaucuguggucuuauaaugccgaacuccuggucgcccuggagaaccagcauaccauugaccucacagauuccgaaaugaauaagcuguucgagaaaaccagaaagcagcuucgggagaacgcugaagacauggggaacggcugcuuuaagaucuaccacaaaugugauaaugcgugcauuggaagcaucagaaacggcacauacgaccaugauguguaucgcgacgaggcccugaauaaccgguuccagauuaaggggguugaacucaaaucuggauacaaggacuggauccuguggaucuccuuugcuauuagcugcuuccuucugugugugguccuccugggcuuuaucaugugggccugccaaaaagggaauauuagauguaacaucugcauuuga

SEQ ID NO: 191586 - RNA, 1701 nt, Artificial Sequence
  derived and/or modified sequence opt5 from hemagglutinin__InfluenzaA__AFG99193
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacgagaagugggaucuguucgucgaacgcuccaaagccuuuucuaauuguuauccuuacgacgugcccgauuaugcuagccucagaucccugguugccagcucugggacgcuugaguucauuaacgaaggauuuaauuggaccggcgugacacaguccggcgggagcuacgcuugcaagcggggaucugucaacuccuucuuuagccgccugaauuggcucuaugagucugaguccaaguacccugcccugaacgugaccaugcccaauaacggcaaauucgaaaagcuguauaucuggggaguucaccauccuagcacagacaaagagcaaaccaaucuguacgugagagcguccgggcgggucacggugucuacaaagcgcagccagcagaccgugauuccgaacaucggccccagaccuuggguccgggggcucuccagccgcauuucuaucuacuggacaauuguuaaacccggagauauccugcugaucaacuccaccggcaaucucauugccccuagaggcuauuuuaagauccggaccgggaaguccucuauuaugcgcagcgacgcucccaucggaacauguuccucugaaugcauuacgccgaacggcagcaucccuaaugauaaacccuuccagaacgugaauaagaucaccuacggggccuguccuagauaugugaaacaaaacacacugaaacuugcuaccggaaugcggaauguccccgagaagcagacacgcggcauuuuuggggccaucgcgggauucauugagaacggcugggaaggcaugguggacgggugguacggauuuagacaccagaauagcgagggcaccgggcaggccgcugaccuuaagagcacgcaagccgcuaucgaucagauuaacggaaaacucaaucggcugaucgaaaagacaaacgagaaguuccaccagaucgaaaaagaguucucugagguugaaggccgcauucaagaccuugagaaguauguggaagauaccaaaaucgaccugugguccuacaaugccgagcuccuggucgcccuggaaaaccagcauaccauugauaugacagacagcgagaugaauaagcucuuugagaaaaccagaaagcagcugcgggaaaacgcugaggauauggggaacggcugcuucaagaucuaucacaaaugugacaaugcgugcauuggaucuaucagaaacggcacauacgaucaugacguguaccgcgaugaagcccuuaauaaccgguuucagauuaaggggguugagcugaaauccggauauaaggacuggauccucuggaucagcuucgcuauuuccugcuuucugcuuugugugguccugcucggcuucaucaugugggccugccaaaaagggaauauuagauguaacaucugcauuuga

SEQ ID NO: 191587 - RNA, 1701 nt, Artificial Sequence
  derived and/or modified sequence opt5 from hemagglutinin__InfluenzaA__AFG99204
augaagaccaucauugcccugagcuacaucuucugccucggcuuugcucagaaacugcccgggaacgacaauuccacagccacgcuuugucugggacaccaugcggugccuaacggcacccucgucaagacaauuaccaaugaucaaaucgagguuacaaacgcuaccgaacuggugcagucuagcuccacagggagaauuugcgacucuccgcaccggauccuugauggcaaaaauuguacccugaucgacgcccuccugggagauccccauugcgacggguuccagaacgagaagugggaucuguuuguggaacgcagcaaagccuucuccaauuguuauccuuacgacguccccgauuaugcuucucucagaagccugguggccuccagcggaacgcuugaguuuauuaacgaaggcuucaauuggaccggcguuacacagucugggggauccuacgcuugcaagcggggcagcgugaacuccuuuuucucucgccugaauuggcucuauaagagcgagucuaaauacccugcccugaacgucaccaugcccaauaacgggaaguuugacaaacuuuauaucuggggagugcaccauccuuccacagauaaggagcaaaccaaucuguacguuagagcgagcggccgggugacggucuccacaaaacgcucucagcagaccgugauuccgaacaucgggagcagacccugggugcggggacucuccagccgcauuucuaucuacuggacaauugucaagccuggcgacauccugcugaucaacuccaccggcaaucucauugcccccagaggguauuucaagauccggaccggaaaaagcucuauuauccgcagcgaugcuccuauuggcacauguuccucugaaugcaucacgcccaacgggagcaucccgaaugacaagccuuuucagaacguuaauaaaauuaccuacggagccugucccagauaugugaagcaaaacacacugaaacuugcuaccggcaugcggaaugugccugagaagcagacacgcgggaucuucggagccauugcgggcuuuaucgaaaacggcugggaggggauggucgacggaugguacggcuucagacaccaaaauuccgaggggaccggacaggccgcugaucugaaaagcacgcaggccgcuauugaccagaucaacggcaagcucaaucggcugaucgaaaagacaaacgagaaauuccaccagauugaaaaggaguuuucugaaguggaggggagaauccaagaucuugagaaauauguugaagacaccaagauugaucugugguccuacaaugccgagcuccugguggcccuggaaaaccagcauaccaucgaccucacagauagcgagaugaauaaacuguucgaaaagacccgcaagcagcuucgggagaacgcugaggacaugggcaacggaugcuuuaaaauuuaucacaagugugauaaugcgugcaucggcucuauuagaaacgggacauacgaccaugaugucuaccgcgacgaagcccugaauaaccgguuccagaucaaaggaguggagcucaaguccggcuauaaagacuggauccuguggauuagcuuugcuaucuccugcuuccuucuguguguugugcuccugggguuuauuaugugggccugccaaaagggaaauaucagauguaacauuugcaucuga

SEQ ID NO: 191588 - RNA, 1701 nt, Artificial Sequence
  derived and/or modified sequence opt5 from hemagglutinin__InfluenzaA__AFG99215
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuuauugaacgcagcaaagccuucuccaauuguuauccuuacgacguccccgauuaugcuucucucagaagccugguggccuccagcgggacgcuugaguuuaucaacgaaggauucaauuggaccggcguuacacagucuggcggguccuacgcuugcaagcggggaagcgugaacuccuuuuucucucgccugaauuggcucuaugagagcgaguacaaguauccugcccugaacgucaccaugcccaauaacggcaaauuugacaaacuuuacauuuggggagugcaccauccuucuacagaaaaggagcaaaccaaucuguacguuagagcguccgggcgggugacggucagcacaaagcgcucccagcagaccgugacaccgaacaucggcucuagacccugggugcgggggcucagcucccgcauuagcaucuauuggaccauugucaaaccuggagauauccugcugaucaacucuaccggcaaucucauugcccccagaggcuacuucaagauccggacagggaaguccagcauuaugcgcucugacgcuccuaucggaacguguagcuccgaaugcauuacccccaacggcucuaucccgaaugauaaaccuuuucagaacguuaauaagaucacauauggggccugucccagauacgugaaacaaaacacccugaaacuugcuacaggaaugcggaaugugccugagaagcagacccgcggcauuuucggggccaucgcgggauuuauugagaacggcugggaaggcauggucgacgggugguauggauucagacaccagaauagcgagggcacggggcaggccgcugaccugaaguccacacaagccgcuaucgaucagauuaacggaaaacucaaucggcugaucgaaaagaccaacgagaaguuccaccagaucgaaaaagaguuuagcgagguggaaggccgcauucaagaccuugagaaguacguugaagauaccaaaaucgaccuguggucuuauaaugccgagcuccugguggcccuggaaaaccagcauacaauugaucucaccgacuccgagaugaauaagcuguucgagaaaacaagaaagcagcuucgggaaaacgcugaggauauggggaacggcugcuuuaagaucuaccacaaaugugacaaugcgugcauuggaagcaucagaaacggcacguacgaucaugacgucuaucgcgaugaagcccugaauaaccgguuccagauuaaggggguggagcucaaaucuggauacaaggacuggauccuguggaucuccuuugcuauuagcugcuuccuucuguguguugugcuccugggcuuuaucaugugggccugccaaaaagggaauauuagauguaacaucugcauuuga

SEQ ID NO: 191589 - RNA, 1701 nt, Artificial Sequence
  derived and/or modified sequence opt5 from hemagglutinin__InfluenzaA__AFG99226
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacucuuucuucucccgccugaauuggcucuaugagagcgaguacaaguauccugcccugaacgugaccaugcccaauaacggcaaauuugacaaacuuuacaucuggggaguucaccauccuucuacagauaaggaacaaaccaaucuguacgugagagcguccgggcgggucacggugagcacaaagcgcucccagcagaccgugauuccgaacaucggcucuagacccuggguccgggggcucagcucccgcauuagcaucuauuggacaauuguuaaaccuggagacauccugucuaucaacuccaccggcaaucugauugcccccagaggcuacuucaagauccggaccgggaaguccucuauuaugcgcagcgaugcuccuaucggaacauguuccucugagugcauuacgcccaacggcagcaucccgaaugacaaaccuuuucagaacgugaauaagaucaccuauggggccugucccagauacgugaaacaaaacacacucaagcuggcuaccggaaugcggaaugucccugaaaaacagacacgcggcauuuucggggccaucgcgggauuuauugagaacggcugggagggcaugguggacgggugguauggauucagacaccagaauagcgaaggcaccgggcaggccgcugaucuuaagagcacgcaagccgcuaucgaccagauuaacggaaaacugaaucggcucaucgagaagacaaacgaaaaguuccaccagaucgagaaagaauuuucugagguugagggccgcauucaagaucuggaaaaguacguggaggacaccaaaaucgaucuuugguccuauaaugccgaacugcucgucgcccuggagaaccagcauaccauugaccugacagauagcgaaaugaauaagcucuuugagaaaaccagaaagcagcugcgggagaacgcugaagacauggggaacggcugcuuuaagaucuaccacaaaugugauaaugcgugcauuggaucuaucagaaacggcacauacgaccaugauguguaucgcgacgaggcccuuaauaaccgguuccagauuaaggggguugaacugaaauccggauacaaggacuggauccucuggaucagcuuugcuauuuccugcuuccugcuuugugugguccugcucggcuuuaucaugugggccugccaaaaagggaauauuagauguaacaucugcauuuga

SEQ ID NO: 191590 - RNA, 1701 nt, Artificial Sequence
  derived and/or modified sequence opt5 from hemagglutinin__InfluenzaA__AFG99237
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaagacuucaauuggaccggagugacacagucuggcggcuccuacgcuugcaagcgggagagcgucaacuccuuuuucucucgccugaauuggcucuaugagagcgaauacaaguauccugcccugaacgugaccaugcccaauaacgggaaauuugagaaacuuuacaucuggggaguucaccauccuucuacagauaaggaacaaaccaaucuguacgugagagcguccggccgggucacggugagcacaaagcgcucccagcagaccgugauuccgaacaucgggucuagacccuggguccggggacucagcucccgcauuagcaucuauuggacaauuguuaaaccuggcgacauccugcugaucaacucuaccgggaaucucauugcccccagaggauacuucaagauccggaccggcaaguccagcauuaugcgcucugaugcuccuaucggcacauguagcuccgagugcauuacgcccaacgggucuaucccgaaugacaaaccuuuucagaacgugaauaagaucaccuauggagccugucccagauacgugcggcaaaacacacugaaacuugcuaccggcaugcgcaaugucccugagaagcagacaagagggauuuucggagccaucgcgggcuuuauugaaaacgggugggagggaaugguggacggcugguauggcuuccggcaccagaauagcgaagggaccggacaggccgcugaucugaaauccacgcaagccgcuaucgaccagauuaacggcaagcucaauagacugaucgagaaaacaaacgaaaaguuccaccagaucgagaaggaguuuagcgaaguugaggggcgcauucaagaucuugaaaaauacguggaggacaccaagaucgaucuguggucuuauaaugccgaacuccuggucgcccuggagaaccagcauaccauugaccucacagauuccgagaugaauaaacuguucgaaaagacccggaaacagcuuagagagaacgcugaagacaugggaaacggcugcuuuaagaucuaccacaagugugauaaugcgugcauugggagcauccgcaacggcacauacgaccaugauguguaucgggacgaggcccugaauaacagauuccagauuaaaggaguugaacucaagucuggcuacaaagacuggauccuguggaucuccuuugcuauuagcugcuuccuucugugugugguccuccugggguuuaucaugugggccugccaaaagggaaauauucgcuguaacaucugcauuuga

SEQ ID NO: 191591 - RNA, 1701 nt, Artificial Sequence
  derived and/or modified sequence opt5 from hemagglutinin__InfluenzaA__AFG99248
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcucccacgcuugcaagcgggggagcgucaacucuuucuuuucccgccugaauuggcuccaugagagcgaguauaaguacccugcccugaacgugaccaugcccaauaacggaaaauucgauaaacuuuauaucuggggcguucaccacccuauuacagacagagaacaaaccaaucuguacgugcgggcgucugggcgcgucacgguguccacaaagagaagccagcagaccgugaucccgaacauuggauuucggcccuggguccgcggccucuccucuagaaucagcauuuacuggacaaucguuaagccuggggauauccugcugauuaacuccaccggaaaucucaucgcuccccggggcuauuucaaaauucgcaacggcaagagcucuaucaugagauccgacgccccuauugggaccuguagcucugagugcaucacacccaauggaagcaucccgaacgacaagccuuuucagaaugugaacaaaauuacguacggcgccuguccccgguaugugaagcaaaauacccugaaacuugcuacagggaugcgcaacgucccugaaaagcagaccagaggaaucuucggcgccauugcgggguuuaucgagaauggaugggagggcaugguggauggcugguacggguuccggcaucagaacuccgaaggaacaggccaggccgcugaccugaaaucuacccaagccgcuauugaucagaucaaugggaagcucaacagacugaucgagaaaacgaaugaaaaguuccaccagauugagaaggaauuuagcgagguugagggacgcauccaagaccuugaaaaauauguggaggauacaaagauugaccugugguccuacaacgccgaacuccuggucgcccuggagaaucagcauaccaucgaucucaccgacagcgaaaugaacaaacuguucgagaagacacggaaacagcuuagagagaacgcugaagauaugggcaaugggugcuuuaagauuuaucacaagugugacaacgcgugcaucggcucuauucgcaauggaaccuacgaucacgacguguaccgggacgaggcccugaacaauagauuccagaucaaaggcguugaacucaaguccggguauaaagauuggauccuguggauuagcuuugcuaucucuugcuuccuucugugugugguccuccugggauuuauuaugugggccugccaaaagggcaacauccgcuguaauauuugcaucuga

SEQ ID NO: 191592 - RNA, 1701 nt, Artificial Sequence
  derived and/or modified sequence opt5 from hemagglutinin__InfluenzaA__AFG99259
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaguggaggugacaaacgcuaccgaacugguccagucuagcuccacaggcagaaucugcgacucuccgcaccggauucuugaugggaaaaauuguacccugaucgacgcccuccugggagauccccauugcgacggcuuccagaacgagaagugggaucuguuuguggaacgcagcaaagccuauuccaauuguuacccuuaugacguucccgauuacgcuucucucagaagccugguggccuccagcgggacgcuugaguucaucaacgaagacuuuaauuggaccggagucacacagucuggcggcuccuaugcuugcaagcgggggagcgugaacucuuucuuuucccgccugaauuggcuccacaagagcgaguacaaauauccugcccugaacguuaccaugcccaauaacggaaaguucgauaaacuuuacauuuggggcgugcaucacccuucuacagacagagagcaaaccaaucuguacguccgggcguccgggcgcgugacggugagcacaaagagaucccagcagaccgucaucccgaacauuggaucucggcccuggguucgcggccucagcuccagaaucagcauuuauuggacaaucgugaaaccuggggauauucugcugaucaacucuaccggaaaucucaucgcuccccggggcuacuuuaagauucgcaccggcaaguccagcaucaugagaucugacgccccuauugggacauguagcuccgaaugcaucacgcccaacggaucuauuccgaaugacaaaccuuuccagaacgugaauaagaucaccuauggcgccuguccccgguacgucaaacaaaacacacugaaacuugcuaccgggaugcgcaaugugccugagaaacagacaagaggaaucuuuggcgccauugcgggguucaucgaaaacggaugggagggcaugguugauggcugguauggguuucggcaccagaauagcgagggaaccggccaggccgcugaccugaaguccacgcaagccgcuauugaucagaucaacgggaaacucaauagacugauugaaaagacaaacgagaaguuccaucagaucgaaaaagaguucagcgaaguggagggacgcauccaagaccuugagaaguacgucgaagauaccaaaauugaccuguggucuuauaaugccgagcuccugguggcccuggaaaaccagcacaccaucgaucucacagacuccgagaugaauaagcuguuugaaaagacccggaagcagcuuagagagaacgcugaggauaugggcaacgggugcuucaagauuuaccauaaaugugacaaugcgugcaucggcagcauucgcaacggaacauacgaucacgacguuuaucgggacgaagcccugaauaacagauuucagaucaagggcguggagcucaaaucuggguacaaggauuggauucuguggaucuccuucgcuaucagcugcuuucuucugugugucgugcuccugggauucauuaugugggccugccaaaaaggcaauauccgcuguaacauuugcaucuga

SEQ ID NO: 191593 - RNA, 1701 nt, Artificial Sequence
  derived and/or modified sequence opt5 from hemagglutinin__InfluenzaA__AFG99270
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacaagagcgaguacaaauauccugcgcugaacgugacaaugcccaauaacggaaaguucgauaaacuuuacaucuggggcguucaucacccuucuaccgacagagagcaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaaaccuggggauauccugcugaucaacucuacaggaaaucucauugcuccccggggcuacuuuaagauccgcaccggcaaguccagcauuaugagaucugacgccccuaucgggaccuguagcuccgaaugcauuacacccaacggaucuaucccgaaugacaaaccuuuccagaacgugaaucggaucacguauggcgcuuguccccgcuacgugaagcaaaacacccugaaacuugccacagggaugagaaaugucccugagaagcagacccggggaauuuuuggcgcgaucgccggguucauugaaaacggaugggagggcaugguggauggcugguauggguuuagacaccauaauagcgagggaacaggccaggcugccgaccugaaauccacccaggcugccaucgaucaaauuaacgggaagcucaaucgccugaucgagaaaacgaacgaaaaguuccaccagaucgaaaaggaguucagcgaaguugagggacggauucaggaccuugagaaauacguggaagauacaaagaucgaccuguggucuuauaaugccgagcuccuggucgcucuggaaaaccaacauaccauugaucucaccgacuccgagaugaauaaacuguuugaaaagacaagaaaacagcuucgcgagaacgcggaggauaugggcaacgggugcuucaagaucuaccacaagugugacaaugccugcauuggcagcauccggaacggaaccuacgaucacgacguguauagagacgaagcucugaauaaccgcuuucagauuaaaggcguugagcucaagucuggguacaaagauuggauccuguggaucuccuucgccauuagcugcuuucuucugugugugguccuccugggauucaucaugugggccugccagaagggcaauauucgguguaacaucugcauuuga

SEQ ID NO: 191594 - RNA, 1701 nt, Artificial Sequence
  derived and/or modified sequence opt5 from hemagglutinin__InfluenzaA__AFG99281
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaagaguucaauuggaccggagugacacagucuggcggcuccuacgcuugcaagcgggggagcgucaacuccuuuuucucucgccugaauuggcuccacaagagcgaguauaaauacccugcccugaacgugaccaugcccaauaacggaagauuugacaaacuuuauaucuggggcguucaucacccuucuacagaucgggaacaaaccaaucuguacgugcgcgcguccgggagagucacggugagcacaaaacggucccagcagaccgugauuccgaacaucggaccccgcccuugggucagaggccucucuagccggauuuccaucuacuggacaauuguuaagcccggggacauccugcugaucaacagcaccggaaaucucauugccccucgcggcuauuucaaaauccacaccggcaagucuuccauuaugagaagcgaugcucccaucgggacauguucuagcgagugcauuacgccgaacggauccaucccuaaugacaagcccuuucagaacgugaauaaaaucaccuacggcgccuguccucgguaugugaagcaaaacacacugaaacuugcuaccgggaugcgcaauguccccgacaagcagacaagaggaauuuucggcgccaucgcgggguuuauugaaaacggaugggagggcaugguggauggcugguacggguuccggcaucaaaauucugagggaaccggccaggccgcugaccugaaaagcacgcaggccgcuaucgaucagauuaacgggaagcucaauagacugaucgaaaagacaaacgagaaguuccaccagaucgaaaaggaguuuuccgaaguugagggacgcauucaagaccuugagaaauauguggaagauaccaagaucgaccuguggagcuacaaugccgagcuccuggucgcccuggaaaaccagcauaccauugaucucacagacucugagaugaauaaacuguucgaaaagacccggaaacagcuuagagagaacgcugaggauaugggcaacgggugcuuuaagaucuaucacaagugugacaaugcgugcauuggcuccauccgcaacggaacauacgaucacgacguguaccgggacgaagcccugaauaacagauuccagauuaaaggcguugagcucaagagcggguauaaagauuggauccuguggaucucuuuugcuauuuccugcuuccuucugugugugguccuccugggauuuaucaugugggccugccaaaagggcaauauucgcuguaacaucugcauuuga

SEQ ID NO: 191595 - RNA, 1701 nt, Artificial Sequence
  derived and/or modified sequence opt5 from hemagglutinin__InfluenzaA__AFG99292
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaguggaggugacaaacgcuaccgaacugguccagucuagcuccacaggcagaaucugcgacucuccgcaccggauucuugaugggaaaaauuguacccugaucgacgcccuccugggagauccccauugcgacggcuuccagaacgagaagugggaucuguuuguggaacgcagcaaagccuauuccaauuguuacccuuaugacguucccgauuacgcuucucucagaagccugguggccuccagcgggacgcuugaguucaucaacgaagacuuuaauuggaccggagucacacagucuggcggcuccuaugcuugcaagcgggggagcgugaacucuuucuuuucccgccugaauuggcuccacgagagcgaguacaaguauccugcccugaacguuaccaugcccaauaacggaaaauucgauaaacuuuacauuuggggcgugcaucacccuucuacagacagagaacaaaccaaucuguacguccgggcguccgggcgcgugacggugagcacaaagagaucccagcagaccgucaucccgaacauuggaucucggcccuggguucgcggccucagcuccagaaucagcauuuauuggacaaucgugaagccuggggauauucugcugaucaacucuaccggaaaucucaucgcuccccggggcuacuuuaaaauucgcaccggcaaguccagcaucaugagaucugacgccccuauugggacauguagcuccgagugcaucacgcccaacggaucuauuccgaaugacaagccuuuccagaacgugaauaaaaucaccuauggcgccuguccccgguacgucaagcaaaacacacugaaacuugcuaccgggaugcgcaaugugccugaaaagcagacaagaggaaucuuuggcgccauugcgggguucaucgagaacggaugggagggcaugguugauggcugguauggguuucggcaccagaauagcgaaggaaccggccaggccgcugaccugaaauccacgcaagccgcuauugaucagaucaacgggaagcucaauagacugauugagaaaacaaacgaaaaguuccaucagaucgagaaggaguucagcgaaguggagggacgcauccaagaccuugaaaaauacgucgaggauaccaagauugaccuguggucuuauaaugccgaacuccugguggcccuggagaaccagcacaccaucgaucucacagacuccgaaaugaauaaacuguuugagaagacccggaaacagcuuagagagaacgcugaagauaugggcaacgggugcuucaagauuuaccauaagugugacaaugcgugcaucggcagcauucgcaacggaacauacgaucacgacguuuaucgggacgaggcccugaauaacagauuucagaucaaaggcguggaacucaagucuggguacaaagauuggauucuguggaucuccuucgcuaucagcugcuuucuucugugugucgugcuccugggauucauuaugugggccugccaaaagggcaauauccgcuguaacauuugcaucuga

SEQ ID NO: 191596 - RNA, 1701 nt, Artificial Sequence
  derived and/or modified sequence opt5 from hemagglutinin__InfluenzaA__AFG99303
augaagaccaucauugcccugagcuacaucuucugccucguggucgcucagaaacugcccggcaacgacaauuccacagccacgcuuugucuggggcaccaugcgguuccuaacggaacccucgugaagacaauuaccaaugaucaaaucgaggugacaaacgcuaccgaacugguccagucuagcuccacaggcagaauuugcgacucuccgcaccggauccuugaugggaaaaauuguacccugaucgacgcccuccugggagauccccauugcgacggcuuucagaacaaggagugggaucuguucguggaacgcagcaaagccuauuccaauuguuacccuuaugacguucccgauuacgcuucucucagaagccugguggccuccagcgggacgcuugaguuuauuaacgaagacuucaauuggaccggagucgcucagucuggcggcuccuaugccugcaagcgggggagcgugaacucuuucuucucccgccugaauuggcuccacgagagcgaguacaaguauccugcgcugaacguuacaaugcccaauaacggaaaauuugauaagcuguacaucuggggcgugcaucacccuucuaccgacagagaacaaacaaaucuguacguccgggccuccgggcgcgugaccgugagcacgaaaagaucccagcagacagucauuccgaacaucggaucucggcccuggguucgcggccucagcuccagaauuagcaucuauuggaccauugugaagccuggggauauccugcugaucaacucuacaggaaaucucauugcuccccggggcuacuucaaaauccgcaccggcaaguccagcauuaugagaucugacgccccuaucgggaccuguagcuccgagugcauuacacccaacggaucuaucagcaaugacaagccguuucagaacgugaaucggaucacguauggcgcuuguccucgcuacgucaaacaaaacacccugaaacuugccacagggaugagaaaugugcccgaaaagcagacccggggaauuuucggcgcgaucgccggguuuauugagaacggaugggagggcaugguugauggcugguauggguucagacaccaaaauuccgaaggaacaggccaggcugccgaccuuaagagcacccaggcugccaucgaucagauuaacgggaaacucaaucgccugaucgagaagacgaacgaaaaauuucaucagaucgagaaggaauuuucugagguggagggacggauucaagaccuugaaaaguacgucgaggauacaaaaaucgaccugugguccuauaaugccgaacuccugguggcucuggagaaccagcacaccauugaucucaccgacagcgaaaugaauaagcuguucgagaaaacaagaaagcagcuucgcgagaacgcggaagauaugggcaacgggugcuuuaaaaucuaccauaagugugacaaugccugcauuggcucuauccggaacggaaccuacgaucacgacguuuauagagacgaggcucugaauaaccgcuuccagauuaagggcguggaacucaaauccggguacaaggauuggauccuguggaucagcuuugccauuuccugcuuccuucugugugucgugcuccugggauuuaucaugugggccugccaaaaaggcaauauucgguguaacaucugcauuuga

SEQ ID NO: 191597 - RNA, 1701 nt, Artificial Sequence
  derived and/or modified sequence opt5 from hemagglutinin__InfluenzaA__AFG99314
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacagcuuccagaacgagaagugggaucuguuugucgaacgcuccaaagccuauucuaauuguuacccuuaugacgugcccgauuacgcuagccucagaucccugguugccagcucuggcacgcuugaguucauuaacgaagacuuuaauuggaccggggugacacaguccggaggcagcuaugcuugcaagcggggcucugucaacuccuucuuuagccgccugaauuggcuccacgagucugaguacaaguauccugcccugaacgugaccaugcccaauaacgggaaauucgauaaacuuuacaucuggggcauucaucacccuuccacagacagagaacaaaccaaucuguacguucgggcgagcggacgcgugacggucuccacaaagagaucucagcagaccgugaucccgaacauugggagccggcccugggugcgcggacucuccagcagaaucucuauuuauuggacaaucgucaagccuggcgauauccugcugauuaacuccaccgggaaucucaucgcuccccggggauacuuuaaacugcgcaccggcaagagcucuauuaugagaagcgacgccccuaucggcacauguuccucugagugcauuacgcccaacgggagcaucccgaaugacaagccuuuccagaacguuaauaaaaucaccuauggagccuguccccgguacgugaagcaaaacacacuuaaacuggcuaccggcaugcgcaaugugccugaaaagcagacaagagggauuuuuggagccaucgcgggcuucauugagaacgggugggagggaauggucgauggcugguauggcuuucggcaccaaaauuccgaagggaccggacaggccgcugaccucaaaagcacgcaggccgcuaucgaucagauuaacggcaagcugaauagacuuaucgagaaaacaaacgaaaaguuccaucagaucgagaaggaguucucugaaguggaggggcgcauucaagaccuggaaaaauacguugaggauaccaagaucgaccucugguccuauaaugccgaacugcugguggcccucgagaaccagcacaccauugaucugacagacagcgaaaugaauaaacuuuuugagaagacccggaaacagcugagagagaacgcugaagauaugggaaacggcugcuucaagaucuaccauaagugugacaaugcgugcauugggucuauccgcaacggcacauacgaucacgacgucuaucgggacgaggcccucaauaacagauuucagauuaaaggaguggaacugaaguccggcuacaaagauuggauccuuuggaucagcuucgcuauuuccugcuuucugcucuguguugugcugcugggguucaucaugugggccugccaaaagggaaauauucgcuguaacaucugcauuuga

SEQ ID NO: 191598 - RNA, 1701 nt, Artificial Sequence
  derived and/or modified sequence opt5 from hemagglutinin__InfluenzaA__AFG99336
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacaagagcgaguacaaauauccugcgcugaacgugacaaugcccaauaacggaaaguucgauaaacuuuacaucuggggcguucaucacccuucuaccgacagagagcaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaaaccuggggauauccugcugaucaacucuacaggaaaucucauugcuccccggggcuacuuuaagauccgcaccggcaaguccagcauuaugagaucugacgccccuaucgggaccuguagcuccgaaugcauuacacccaacggaucuaucccgaaugacaaaccuuuccagaacgugaaucggaucacguauggcgcuuguccccgcuacgugaagcaaaacacccugaaacuugccacagggaugagaaaugucccugagaagcagacccggggaauuuuuggcgcgaucgccggguucauugaaaacggaugggagggcaugguggauggcugguauggguuuagacaccagaauagcgagggaacaggccaggcugccgaccugaaauccacccaagcugccaucgaucagauuaacgggaagcucaaucgccugaucgagaaaacgaacgaaaaguuccaucagaucgaaaaggaguucagcgaaguugagggacggauucaagaccuugagaaauacguggaagauacaaagaucgaccuguggucuuauaaugccgagcuccuggucgcucuggaaaaccagcacaccauugaucucaccgacuccgagaugaauaaacuguuugaaaagacaagaaaacagcuucgcgagaacgcggaggauaugggcaacgggugcuucaagaucuaccauaagugugacaaugccugcauuggcagcauccggaacggaaccuacgaucacgacguguauagagacgaagcucugaauaaccgcuuucagauuaaaggcguugagcucaagucuggguacaaagauuggauccuguggaucuccuucgccauuagcugcuuucuucugugugugguccuccugggauucaucaugugggccugccaaaagggcaauauucgguguaacaucugcauuuga

SEQ ID NO: 191599 - RNA, 1701 nt, Artificial Sequence
  derived and/or modified sequence opt5 from hemagglutinin__InfluenzaA__AFG99347
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacaagccugaguacaaauaucccgcgcugaacgugacaaugccuaauaacggaaaguucgauaaacuuuacaucuggggcguucaucacccgagcaccgacagagagcaaacaaaucuguacgugcgggccucugggcgcgucaccguguccacgaagagaagccagcagacagugauucccaacaucggaucccggccuuggguccgcggccucucuagcagaauuuccaucuauuggaccauuguuaaacccggggauauccugcugaucaacagcacaggaaaucucauugcuccucggggcuacuuuaagauccgcaccggcaagucuuccauuaugagaagcgacgcccccaucgggaccuguucuagcgaaugcauuacaccgaacggauccaucccuaaugacaaacccuuccagaacgugaaucggaucacguauggcgcuuguccucgcuacgugaagcaaaacacccugaaacuugccacagggaugagaaauguccccgagaagcagacccggggaauuuuuggcgcgaucgccggguucauugaaaacggaugggagggcaugguggauggcugguauggguuuagacaccaaaauucugagggaacaggccaggcugccgaccugaaaagcacccaggcugccaucgaucagauuaacgggaagcucaaucgccugaucgacaaaacgaacgaaaaguuccaucagaucgagaaggaguucuccgaaguugaaggacggauucaagaucuugagaaauacguggaggacacaaagaucgaucuguggagcuauaaugccgaacuccuggucgcucuggagaaccagcacaccauugaccucaccgauucugaaaugaauaaacuguuugagaagacaagaaaacagcuucgcgaaaacgcggaggacaugggcaacgggugcuucaagaucuaccauaagugugauaaugccugcauuggcuccauccggaacggaaccuacgaccacgacguguauagagaugaggcucugaauaaccgcuuucagauuaaaggcguugaacucaagagcggguacaaagacuggauccuguggaucucuuucgccauuuccugcuuucuucugugugugguccuccugggauucaucaugugggccugccaaaagggcaauauucgguguaacaucugcauuuga

SEQ ID NO: 191600 - RNA, 1701 nt, Artificial Sequence
  derived and/or modified sequence opt5 from hemagglutinin__InfluenzaA__AFG99358
augaagaccaucauugcccugagccacauccucugccugguguucgcucagaaacuucccggcaacgacaauuccacagccacgcugugucucgggcaucacgcggucccuaacggaacccugguuaagacaauuaccaaugaucaaaucgaggugacaaacgcuaccgaacuugugcagucuagcuccacaggcagaauuugcgacucuccgcaucggauccuggaugggaaaaauuguacccucaucgacgcccugcugggagauccccacugcgacggcuuucagaacaaggagugggaucucuucgucgaacgcagcaaagccuacuccaauuguuauccuuacgacgugcccgauuaugcuucucugagaagccuuguugccuccagcgggacgcuggaguuuauuaacgaagacuucaauuggaccggaguggcucaggauggcggcucuuacgccugcaagcggggguccgucaacagcuuuuucucucgccucaauuggcugcauaaacuugaguauaaguacccugcgcugaacgugacaaugcccaauaacggaaaguuugacaaacucuauaucuggggcguucaccacccuuccaccgauagcgaccaaacaucucuguacgugagagccuccgggcgggucaccgugagcacgaagcgcucccagcagacagugaccccgaauauuggaucuagacccuggguccggggccugagcucccgcaucagcauuuacuggacaaucguuaaaccuggggacauucuccugaucaacucuaucggaaaccuuauugcucccagaggcuauuucaagauccggaauggcaaguccagcauuaugcgcucugaugugccuaucgggaacuguagcuccgagugcauuacccccaauggaucuaucccgaacgacaaaccuuuucagaaugugaacagaaucaccuacggcgccuguccccgguaugucaagcaaaauacacugaaacucgcuacggggaugcgcaacgugccugaaaagcagaccagaggaauuuucggcgccaucgcgggguuuauugagaauggaugggaaggcaugguugauggcugguacggguuccggcaucagaacagcgagggaacaggccaggccgcugaccugaaauccacccaagccgcuaucgaucagauuaaugggaaacuuaacagacugaucgagaagacaaaugaaaaguuucaccagaucgagaaggaguucagcgaaguggaaggacgcauucaagaccucgagaaauaugucgaggauaccaagaucgaccuguggucuuacaacgccgaacugcucguggcccuggagaaucagcauacgauugaucuuacagacuccgaaaugaacaaacuguucgagaagacccggaaacagcucagagaaaacgcugaggauaugggcaaugggugcuuuaagaucuaucacaagugugacaacgcgugcauuggcagcauccgcaauggaaccuacgaccacgauguuuaccgggacgaggcccugaacaauagauuccagauuaaaggcguggaacuuaagucuggguauaaagauuggauccuguggaucuccuuugcuauuagcugcuuccuccugugugucgugcugcucggauuuaucaugugggccugccaaaagggcaacauucgcuguaauaucugcauuuga

SEQ ID NO: 191601 - RNA, 1701 nt, Artificial Sequence
  derived and/or modified sequence opt5 from hemagglutinin__InfluenzaA__AFG99369
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauugggcuggaguggcccagucuggcggcuccuaugcgugcaagcgggggagcgucaacucuuucuuuucccgccugaauuggcuccacgagagcgaguacaaguauccugcccugaacgugaccaugcccaauaacggaaaauucgauaaacuuuacaucuggggcguucaucacccuucuacagacagagaacaaaccaaucuguacgugcgggcuuccgggcgcgucacagugagcaccaagagaucccagcagacggugauuccgaacaucggaucucggcccuggguccgcggccucagcuccagaauuagcaucuauuggacaauuguuaagccuggggauauccugcugaucaacucuaccggaaaucucauugcuccccggggcuacuuuaaaauccgcacaggcaaguccagcauuaugagaucugacgccccuaucgggaccuguagcuccgagugcauuacccccaacggaucuaucccgaaugacaagccuuuccagaacgugaaucggaucacauauggcgccuguccccgcuacgugaaacaaaacacgcugaaacuugcgaccgggaugagaaaugucccugaaaagcagacacggggaauuuuuggcgccaucgcuggguucauugagaacggaugggagggcaugguggauggcugguauggguuuagacaccagaauagcgaaggaaccggccaggccgcugaccugaaguccacacaagccgccaucgaucagauuaacgggaaacucaaucgccugaucgagaagaccaacgaaaaauuccaucagaucgagaaggaguucagcgaaguugagggacggauucaagaccuugaaaaguacguggaggauacgaaaaucgaccuguggucuuauaaugcugaacuccuggucgcgcuggagaaccagcacacaauugaucucaccgacuccgaaaugaauaagcuguuugagaaaaccagaaagcagcuucgcgagaacgccgaagauaugggcaacgggugcuucaaaaucuaccauaagugugacaaugcuugcauuggcagcauccggaacggaacauacgaucacgacguguauagagacgaggcccugaauaaccgcuuucagauuaagggcguugaacucaaaucuggguacaaggauuggauccuguggaucuccuucgccaccagcugcuuucuucugugugugguccuccugggauucauuaugugggcuugccaaaaaggcaauauccgguguaacauuugcaucuga

SEQ ID NO: 191602 - RNA, 1701 nt, Artificial Sequence
  derived and/or modified sequence opt5 from hemagglutinin__InfluenzaA__AFG99380
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaagccuggggauauccugcugaucaacucuacaggaaaucucauugcuccccggggcuacuuuaaaauccgcaccggcaaguccagcauuaugagaucugacgccccuaucgggaccuguagcuccgagugcauuacacccaacggaucuaucccgaaugacaagccuuuccagaacgugaaucggaucacguauggcgcuuguccccgcuacgugaaacaaaacacccugaaacuugccacagggaugagaaaugucccugaaaagcagacccggggaauuuuuggcgcgaucgccggguucauugagaacggaugggagggcaugguggauggcugguauggguuuagacaccagaauagcgaaggaacaggccaggcugccgaccugaaguccacccaagcugccaucgaucagauuaacgggaaacucaaucgccugaucgagaagacgaacgaaaaauuccaucagaucgagaaggaguucagcgaaguugagggacggauucaagaccuugaaaaguacguggaggauacaaaaaucgaccuguggucuuauaaugccgaacuccuggucgcucuggagaaccagcacaccauugaucucaccgacuccgaaaugaauaagcuguuugagaaaacaagaaagcagcuucgcgagaacgcggaagauaugggcaacgggugcuucaaaaucuaccauaagugugacaaugccugcauuggcagcauccggaacggaaccuacgaucacgacguguauagagacgaggcucugaauaaccgcuuucagauuaagggcguugaacucaaaucuggguacaaggauuggauccuguggaucuccuucgccauuagcugcuuucuucugugugugguccuccugggauucaucaugugggccugccaaaaaggcaauauucgguguaacaucugcauuuga

SEQ ID NO: 191603 - RNA, 1701 nt, Artificial Sequence; identical to SEQ ID NO: 191602
  derived and/or modified sequence opt5 from hemagglutinin__InfluenzaA__AFG99391

SEQ ID NO: 191604 - RNA, 1701 nt, Artificial Sequence
  derived and/or modified sequence opt5 from hemagglutinin__InfluenzaA__AFG99402
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacaagagcgaguacaaauauccugcccugaacgugaccaugcccaauaacggaaaguucgauaaacuuuacaucuggggcguucaucacccugugacagacagagagcaaaccaaucuguacguccgggcgucugggcgcgugacgguguccacaaagagaagccagcagaccgucauuccgaacaucggaucccggcccuggguucgcggccucucuagcagaauuuccaucuauuggacaauugugaaaccuggggauauccugcugaucaacagcaccggaaaucucauugcuccccggggcuacuuuaagauccgcaccggcaagucuuccauuaugagaagcgacgccccuaucgggacauguucuagcgaaugcauuacgcccaacggauccaucccgaaugacaaaccuuuccagaacgugaauaagaucaccuauggcgccuguccccgguacgucaaacaaaacacacugaaacuugcuaccgggaugcgcaaugugccugagaaacagacaagaggaauuuuuggcgccaucgcgggguucauugaaaacggaugggagggcaugguugauggcugguauggguuucggcaccagaauagcgagggaaccggccaggccgcugaccugaagucuacgcaagccgcuaucgaucagauuaacgggaaacucaauagacugaucgaaaagacaaacgagaaguuccaucagaucgaaaaagaguucuccgaaguggagggacgcauucaagaccuugagaaguacgucgaagauaccaaaaucgaccuguggagcuauaaugccgagcuccugguggcccuggaaaaccagcacaccauugaucucacagacucugagaugaauaagcuguuugaaaagacccggaagcagcuuagagagaacgcugaggauaugggcaacgggugcuucaagaucuaccauaaaugugacaaugcgugcauuggcuccauccgcaacggaacauacgaucacgacguuuaucgggacgaagcccugaauaacagauuucagauuaagggcguggagcucaaaagcggguacaaggauuggauccuguggaucucuuucgcuauuuccugcuuucuucugugugucgugcuccugggauucaucaugugggccugccaaaaaggcaauauucgcuguaacaucugcauuuga

SEQ ID NO: 191605 - RNA, 1701 nt, Artificial Sequence
  derived and/or modified sequence opt5 from hemagglutinin__InfluenzaA__AFG99413
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaagccuggggauauccugcugaucaacucuacaggaaaucucauugcuccccggggcuacuuuaaaauccgcaccggcaaguccagcauuaugagaucugacgccccuaucgggaccuguagcuccgagugcauuacacccaacggaucuaucccgaaugacaagccuuuccagaacgugaaucggaucacguauggcgcuuguccccgcuacgugaaacaaaacacccugaaacuugccacagggaugagaaaugucccugaaaagcagacccggggaauuuuuggcgcgaucgccggguucauugagaacggaugggagggcaugguggauggcugguauggguuuagacaccagaauagcgaaggaacaggccaggcugccgaccugaaguccacccaagcugccaucgaucagauuaacgggaaacucaaucgccugaucgagaagacgaacgaaaaauuccaucagaucgagaaggaguucagcgaaguugagggacggauucaagaccuugaaaaguacguggaggauacaaaaaucgaccuguggucuuauaaugccgaacuccuggucgcucuggagaaccagcacaccauugaucucaccgacuccgaaaugaauaagcuguuugagaaaacaagacgccagcuucgggagaacgcggaagauaugggcaacgggugcuucaagaucuaccauaaaugugacaaugccugcauuggcagcaucagaaacggaaccuacgaucacgacguguaucgcgacgaggcucugaauaaccgguuucagauuaagggcguugaacucaagucuggguacaaagauuggauccuguggaucuccuucgccauuagcugcuuucuucugugugugguccuccugggauucaucaugugggccugccaaaagggcaauauuagauguaacaucugcauuuga

SEQ ID NO: 191606 - RNA, 1701 nt, Artificial Sequence
  derived and/or modified sequence opt5 from hemagglutinin__InfluenzaA__AFG99424
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacaagagcgaguacaaauauccugcgcugaacgugacaaugcccaauaacggaaaguucgauaaacuuuacaucuggggcguucaucacccuucuaccgacagagagcaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaaaccuggggauauccugcugaucaacucuacaggaaaucucauugcuccccggggcuacuuuaagauccgcaccggcaaguccagcauuaugagaucugacgccccuaucgggaccuguagcuccgaaugcauuacacccaacggaucuaucccgaaugacaaaccuuuccagaacgugaaucggaucacguauggcgcuuguccccgcuacgugaagcaaaacacccugaaacuugccacagggaugagaaaugucccugagaagcagacccggggaauuuuuggcgcgaucgccggguucauugaaaacggaugggagggcaugguggauggcugguauggguuuagacaccagaauagcgagggaacaggccaggcugccgaccugaaauccacccaagcugccaucgaucagauuaacgggaagcucaaucgccugaucgagaaaacgaacgaaaaguuccaucagaucgaaaaggaguucagcgaaguugagggacggauucaagaccuugagaaauacguggaagauacaaagaucgaccuguggucuuauaaugccgagcuccuggucgcucuggaaaaccagcacaccauugaucucaccgacuccgagaugaauaaacuguuugaaaagacaagacgccagcuucgggagaacgcggaggauaugggcaacgggugcuucaaaaucuaccauaagugugacaaugccugcauuggcagcaucagaaacggaaccuacgaucacgacguguaucgcgacgaagcucugaauaaccgguuucagauuaagggcguugagcucaaaucuggguacaaggauuggauccuguggaucuccuucgccauuagcugcuuucuucugugugugguccuccugggauucaucaugugggccugccaaaaaggcaauauuagauguaacaucugcauuuga

SEQ ID NO: 191607 - RNA, 1701 nt, Artificial Sequence
  derived and/or modified sequence opt5 from hemagglutinin__InfluenzaA__AFG99435
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagaauagcagcacaggcagaauuugcgacuccccgcaccggauccuugaugggaaaaacuguacccugaucgacgcccuccugggagauccccauugcgacggccugcagaauaaggagugggaucucuucgucgaacgcucuaaagccuauagcaacuguuacccuuaugacgugcccgauuacgcuucccugagaucucuuguugccagcuccgggacgcuggaguuuaccaaggaagacuucaauuggacaggaguggcucagagcggcggcucuuaugccugcaagcggggguccgucaacagcuuuuucucucgccucaauuggcugcacgaguccgaguacaaauauccugcgcuuaacgugaccaugcccaauaacggaaaguuugauaaacuguacauuuggggcguucaucacccuagcacagacagagaacaaaccaaucucuacgugcgggccucugggcgcgucacgguguccacaaagagaagccagcagaccgugaucccgaacauuggaucccggcccuggguccgcggccugucuagcagaaucuccauuuauuggacaaucguuaaaccuggggauauucugcucaucaacagcaccggaaaucugaucgcuccccggggcuacuucaagauucgcaccggcaagucuuccaucaugagaagcgacgccccuauugggacauguucuagcgagugcaucacgcccaacggauccauuccgaaugacaaaccuuuucagaacgugaaucggaucaccuauggcgcuuguccccgcuacgugaagcaaaacacacuuaaacuggccaccgggaugagaaaugucccugaaaagcagacacggggaaucuucggcgcgauugccggguuuaucgagaacggaugggagggcaugguggauggcugguauggguucagacaccaaaauucugaaggaaccggccaggcugccgaccucaaaagcacgcaggcugccauugaucagaucaacgggaagcugaaucgccuuauugagaaaacaaacgaaaaguuucaucagaucgagaaggaguucuccgaaguugagggacggauccaagaccuggaaaaauacguggaggauaccaagauugaccucuggagcuauaaugccgaacugcuggucgcucucgagaaccagcacaccaucgaucugacagacucugaaaugaauaaacuuuucgagaagaccagaaaacagcugcgcgagaacgcggaagauaugggcaacgggugcuuuaagauuuaccauaagugugacaaugccugcaucggcuccauucggaacggaacauacgaucacgacguguauagagacgaggcucucaauaaccgcuuccagaucaaaggcguugaacugaagucuggguacaaagauuggauucuuuggaucucuuuugccaucuccugcuuccugcucugugugguccugcugggauuuauuaugugggccugccaaaagggcaauauccgguguaacauuugcaucuga

SEQ ID NO: 191608 - RNA, 1701 nt, Artificial Sequence; identical to SEQ ID NO: 191607
  derived and/or modified sequence opt5 from hemagglutinin__InfluenzaA__AFG99446

SEQ ID NO: 191609 - RNA, 1701 nt, Artificial Sequence
  derived and/or modified sequence opt5 from hemagglutinin__InfluenzaA__AFG99457
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuauuaacgaggacuucaauuggaccggaguggcucagucuggcggcuccuaugccugcaaacgggggagcgucaacagcuuuuucucccgccucaauuggcugcacaagagcgaguacaaguauccugcgcuuaacgugacaaugcccaauaacggaaaauuugauaagcuguacaucuggggcguucaucacccuucuaccgacagagaucaaacaucccucuacgugcgggccagcgggcgcgucaccguguccacgaaaagaucucagcagacagugauuccgaauaucggaagccggcccuggguccgcggccaguccagcagaauuucuaucuauuggaccauuguuaagccuggggacauccugcugaucaacuccacaggaaaccucauugcuccccggggcuacuucaaaauccgcaauggcaagagcucuauuaugagaagcgacgccccuaucgggaccuguuccucugaaugcauuacccccaacggaagcaucccgaaugauaagccuuuucaaaacgugaaucggaucacauauggcgcuuguccccgcuacgugaaacagaacacgcugaaacuugccaccgggaugagaaaugucccugagaaacagacacggggaauuuucggcgcgaucgccggguuuauugaaaacggaugggagggcaugguggacggcugguauggguucagacaccaaaauuccgagggaaccggccaggcugccgaucugaagucuacacaggcugccaucgaccagauuaacgggaaacucaaucgccugaucgaaaagaccaacgagaaauuucaucaaaucgaaaaggaguucucugaaguugagggacggauucaggaucuugagaaguacguggaagacacgaaaaucgaucugugguccuauaaugccgagcuccuggucgcucuggaaaaccagcacacaauugaccucaccgauagcgagaugaauaagcuguucgaaaagaccagaaagcagcuucgcgagaacgcggaggacaugggcaacgggugcuuuaaaaucuaccauaagugugauaaugccugcauuggcucuauccggaacggaacauacgaccacgacguguauagagaugaagcucugaauaaccgcuuccaaauuaagggcguugagcucaaauccggguacaaggacuggauccuguggaucagcuuugccauuuccugcuuccuucugugugugguccuccugggauuuaucaugugggccugccagaaaggcaauauucgguguaacaucugcauuuga

SEQ ID NO: 191610 - RNA, 1701 nt, Artificial Sequence
  derived and/or modified sequence opt5 from hemagglutinin__InfluenzaA__AFG99468
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaagccuggggauauccugcugaucaacucuacaggaaaucucauugcuccccggggcuacuuuaaaauccgcaccggcaaguccagcauuaugagaucugacgccccuaucgggaccuguagcuccgagugcauuacacccaacggaucuaucccgaaugacaagccuuuccagaacgugaaucggaucacguauggcgcuuguccccgcuacgugaaacaaaacacccugaaacuugccacagggaugagaaaugucccugaaaagcagacccggggaauuuuuggcgcgaucgccggguucauugagaacggaugggagggcaugguggauggcugguauggguuuagacaccagaauagcgaaggaacaggccaggcugccgaccugaaguccacccaagcugccaucgaucagauuaacgggaaacucaaucgccugaucgagaagacgaacgaaaaauuccaucagaucgagaaggaguucagcgaaguugagggacggauucaagaccuugaaaaguacguggaggauacaaaaaucgaccuguggucuuauaaugccgaacuccuggucgcucuggagaaccagcacaccauugaucucaccgacuccgaaauggauaagcuguuugagaaaacaagaaagcagcuucgcgagaaugcggaagacaugggcaacgggugcuucaaaaucuaccauaagugugauaacgccugcauuggcagcauccggaauggaaccuacgaccacgacguguauagagaugaggcucugaacaaucgcuuucagauuaagggcguugaacucaaaucuggguacaaggacuggauccuguggaucuccuucgccauuagcugcuuucuucugugugugguccuccugggauucaucaugugggccugccaaaaaggcaacauucgguguaauaucugcauuuga

SEQ ID NO: 191611 - RNA, 1701 nt, Artificial Sequence
  derived and/or modified sequence opt5 from hemagglutinin__InfluenzaA__AFG99490
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucauugaacgcagcaaagccuauuccaauuguuacccuuaugacguccccgauuacgcuucucugagaagccuuguggccuccagcgggacgcuggaguuuaucaacgaagacuucaauuggaccggaguugcucagucuggcgaguccuaugccugcaagcggggcagcgugaaguccuuuuucucucgccucaacuggcugcacgagagcgaauacaaauauccugcgcuuaaugucacaaugcccaacaaugggaaguuugauaaacuguacauuuggggagugcaucacccuucuaccgacagagagcaaacaucccucuacguucgggccagcggccgcgugaccgucuccacgaagagaucucagcagacagugaucccgaacauugggagccggcccugggugcgcggacuguccagcagaaucucuauuuauuggaccaucgucaaaccuggcgauauccugcucauuaauuccacagggaaccugaucgcuccccggggauacuucaagauucgcaccggcaagagcucuaucaugagaagcgacgccccuauuggcaccuguuccucugaaugcaucacacccaacgggagcaucccgaaugacaaaccuuuucagaacguuaaucggauuacguauggagcuuguccccgcuacgugaagcaaaacacccuuaaacuggccacaggcaugagaaaugugccugagaagcagacccgggggaucuucggagcgauugccggcuuuaucgagaacgggugggaaggaauggucgauggcugguauggcuucagacaccaaaauuccgaggggacaggacaggcugccgaccucaaaagcacccaggcugccauugaucagaucaacggcaagcugaaucgccuuaucgagaaaacgaacgaaaaguuucaucagauugaaaaggaguucucugagguggaagggcggauccaagaccuggagaaauacguugaagauacaaagauugaccucugguccuauaaugccgagcugcugguggcucucgaaaaccagcacaccaucgaucugaccgacagcgagaugaauaaacuuuucgagaagacaagaaaacagcugcgcgaaaacgcggaggauaugggaaauggcugcuuuaagauuuaccauaagugugacaacgccugcaucgggucuauucggaacggcaccuacgaucacgacgucuauagagacgaagcucucaauaaccgcuuccagaucaaaggaguggagcugaaguccggcuacaaagauuggauccuuuggauuagcuuugccaucuccugcuuccugcucuguguugugcugcugggguuuauuaugugggccugccaaaagggaaauauccgguguaacauuugcaucuga

SEQ ID NO: 191612 - RNA, 1701 nt, Artificial Sequence
  derived and/or modified sequence opt5 from hemagglutinin__InfluenzaA__AFG99501
augaagaccaucauugcccugagcuacaucuucugccucguggucgcucagaaacugcccggcaacgacaauuccacagccacgcuuugucuggggcaccaugcgguuccuaacggaacccucgugaagacaauuaccaaugaucaaaucgaggugacaaacgcuaccgaacugguccagucuagcuccacaggcagaauuugcgacucuccgcaccggauccuugaugggaaaaauuguacccugaucgacgcccuccugggagauccccauugcgacggcuuucagaacaaggagugggaucuguucguggaacgcagcaaagccuauuccaauuguuacccuuaugacguucccgauuacgcuucucucagaagccugguggccuccagcgggacgcuugaguuuauuaacgaagacuucaauuggaccggagucgcucagucuggcggcuccuauacaugcaagcgggggagcgugaacucuuucuucucccgccugaauuggcuccacgagagcgaguacaaguauccugcccugaacguuaccaugcccaauaacggaaaauuugauaagcuguacaucuggggcgugcaucacccuucuacagacagagaacaaaccaaucuguacguccgggcguccgggcgcgugacggugagcacaaaaagaucccagcagaccgucauuccgaacaucggaucucggcccuggguucgcggccucagcuccagaauuagcaucuauuggacaauugugaagccuggggauauccugcugaucaacucuaccggaaaucucauugcuccccggggcuacuucaaaauccgcaccggcaaguccagcauuaugagaucugacgccccuaucgggacauguagcuccgagugcauuacgcccaacggaucuaucagcaaugacaagccguuucagaacgugaaucggaucaccuauggcgccuguccucgcuacgucaaacaaaacacacugaaacuugcuaccgggaugagaaaugugcccgaaaagcagacacggggaauuuucggcgccaucgcgggguuuauugagaacggaugggagggcaugguugauggcugguauggguucagacaccaaaauuccgaaggaaccggccaggccgcugaccuuaagagcacgcaggccgcuaucgaucagauuaacgggaaacucaaucgccugaucgagaagacaaacgaaaaauuucaucagaucgagaaggaauuuucugagguggagggacggauucaagaccuugaaaaguacgucgaggauaccaaaaucgaccugugguccuauaaugccgaacuccugguggcccuggagaaccagcacaccauugaucucacagacagcgaaaugaauaagcuguucgagaaaaccagaaagcagcuucgcgagaacgcugaagauaugggcaacgggugcuuuaaaaucuaccauaagugugacaaugcgugcauuggcucuauccggaacggaacauacgaucacgacguuuauagagacgaggcccugaauaaccgcuuccagauuaagggcguggaacucaaauccggguacaaggauuggauccuguggaucagcuuugcuauuuccugcuuccuucugugugucgugcuccugggauuuaucaugugggccugccaaaaaggcaauauucgguguaacaucugcauuuga

SEQ ID NO: 191613 - RNA, 1701 nt, Artificial Sequence
  derived and/or modified sequence opt5 from hemagglutinin__InfluenzaA__AFG99512
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgauuccuaugccugcaagcggggcagcgucaagucuuucuucucccgccucaacuggcugcacgagagcgaguacaaauauccugcgcuuaaugugacaaugcccaacaaugacaaguuugauaaacuguacaucuggggaguucaucacccuucuaccgacagagaacaaacaucccucuacauucgggccagcgggcgcgugaccgucuccacgaagagaucucagcagacagugaucccgaacauuggcagccggcccugggugcgcgggcuguccagcagaaucucuauuuauuggaccaucgucaaaccuggagacauccugcucauuaauuccacaggcaaccugaucgcuccccggggguacuucaagauucgcaccggaaagagcucuaucaugagaagcgaugccccuauuggcaccuguuccucugagugcaucacacccaacggcagcaucccgaaugacaaaccuuuucagaacguuaaucggauuacguauggggcuuguccccgcuacgugaagcaaaacacccuuaaacuggccacaggaaugagaaaugugccugaaaagcagacccggggcaucuucggggcgauugccggauuuaucgagaacggcugggaggggauggucgauggaugguauggcuucagacaccaaaauuccgaaggcacagggcaggcugccgaccucaaaagcacccaggcugccauugaucagaucaacggaaagcugaaucgccuuaucgagaaaacgaacgaaaaguuucaucagauugagaaggaauuuucugagguggagggccggauccaagaccuggaaaaauacguugaggauacaaagauugaccucugguccuauaaugccgaacugcugguggcucucgagaaccagcacaccaucgaucugaccgacagcgaaaugaauaaacuuuucgagaagacaagaaaacagcugcgcgagaacgcggaagauauggggaauggaugcuuuaagauuuaccauaagugugacaacgccugcaucggcucuauucggaacgggaccuacgaccacgaugucuauagagacgaggcucucaauaaccgcuuccagaucaaaggcguggaacugaaguccggauacaaagauuggauccuuuggauuagcuuugccaucuccugcuuccugcucuguguugugcugcugggcuuuauuaugugggccugccaaaaggggaauauccgguguaacauuugcaucuga

SEQ ID NO: 191614 - RNA, 1701 nt, Artificial Sequence
  derived and/or modified sequence opt5 from hemagglutinin__InfluenzaA__AFG99523
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagccaauacaaguauccugcgcugaacgugacaaugcccaauaacggaaaauucgauaaacuuuacaucuggggcguucaucacccuucuaccgacagagagcagacaaaucuguacgugcgggccuccgggcgcgucaccgugagcacgaaaagaucccagcagacagugauuccgaacaucggaucucggcccuggguccgcggccucagcuccagaauuagcaucuauuggaccauuguuaagccuggggauauccugcugaucaacucuacaggaaaucucauugcuccccggggcuacuuuaaaauccgcaccggcaaguccagcauuaugagaucugacgccccuaucgggaccuguagcuccgaaugcauuacacccaacggaucuaucccgaaugacaagccuuuccaaaacgugaaucggaucacguauggcgcuuguccccgcuacgugaaacagaacacccugaaacuugccacagggaugagaaaugucccugagaagcagacccggggaauuuuuggcgcgaucgccggguucauugaaaacggaugggagggcaugguggauggcugguauggguuuagacaccagaauagcgagggaacaggccaagcugccgaccugaaguccacccaggcugccaucgaucagauuaacgggaaacucaaucgccugaucgaaaagacgaacgagaaauuccaucaaaucgaaaaggaguucagcgaaguugagggacggauucaggaccuugagaaguacguggaagauacaaaaaucgaccuguggucuuauaaugccgagcuccuggucgcucuggaaaaccagcacaccauugaucucaccgacuccgagaugaauaagcuguuugaaaagacaagaaagcagcuucgcgagaacgcggaggauaugggcaacgggugcuucaaaaucuaccauaagugugacaaugccugcauuggcagcauccggaacggaaccuacgaucacgacguguauagagacgaagcucugaauaaccgcuuucaaauuaagggcguugagcucaaaucuggguacaaggauuggauccuguggaucuccuucgccauuagcugcuuucuucugugugugguccuccugggauucaucaugugggccugccagaaaggcaauauucgguguaacaucugcauuuga

SEQ ID NO: 191615 - RNA, 1701 nt, Artificial Sequence; identical to SEQ ID NO: 191511
  derived and/or modified sequence opt5 from hemagglutinin__InfluenzaA__AFG99534

SEQ ID NO: 191616 - RNA, 1701 nt, Artificial Sequence; identical to SEQ ID NO: 191511
  derived and/or modified sequence opt5 from hemagglutinin__InfluenzaA__AFG99545

SEQ ID NO: 191617 - RNA, 1701 nt, Artificial Sequence
  derived and/or modified sequence opt5 from hemagglutinin__InfluenzaA__AFG99556
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaagacuucaauuggacaggaguggcucagucuggcgaguccuaugccugcaagcggggcagcgucaagucuuucuucucccgccucaacuggcugcacgagagcgauuacaaauauccugcgcuuaaugugaccaugcccaacaaugggaaguuugacaaacuguacauuuggggaguucaucacccuucuacagauagagaacaaaccucccucuacgugcgggccagcggccgcgucacgguguccacaaagagaucucagcagaccgugaucccgaacauugggagccggcccuggguccgcggacuguccagcagaaucucuauuuauuggacaaucguuaaaccuggcgacauucugcucaucaauuccaccgggaaccugaucgcuccccggggauacuucaagauucgcaccggcaagagcucuaucaugagaagcgacgccccuauuggcacauguuccucugagugcaucacgcccaacgggagcauuccgaaugauaaaccuuuucagaacgugaaucggaucaccuauggagcuuguccccgcuacgugaagcaaaacacacuuaaacuggccaccggcaugagaaaugucccugaaaagcagacacgggggaucuucggagcgauugccggcuuuaucgagaacgggugggagggaaugguggacggcugguauggcuucagacaccaaaauuccgaagggaccggacaggcugccgaucgcaaaagcacgcaggcugccauugaccagaucaacggcaagcucaaucggcugauugagaaaacaaacgaaaaguuucaucagaucgagaaggaauuuucugagguugaggggagaauccaagaucuugaaaaauacguggaggacaccaagauugaucugugguccuauaaugccgaacuccuggucgcucuggagaaccagcacaccaucgaccucacagauagcgaaaugaauaaacuguucgagaagacccgcaaacagcuucgggagaacgcggaagacaugggaaauggcugcuuuaagauuuaccauaagugugauaacgccugcaucgggucuauuagaaacggcacauacgaccacgacguguaucgcgaugaggcucugaauaaccgguuccagaucaaaggaguugaacucaaguccggcuacaaagacuggauucuguggaucagcuuugccaucuccugcuuccuucugugugugguccuccugggguuuauuaugugggccugccaaaagggaaauaucagauguaacauuugcaucuga

SEQ ID NO: 191618 - RNA, 1701 nt, Artificial Sequence; identical to SEQ ID NO: 191511
  derived and/or modified sequence opt5 from hemagglutinin__InfluenzaA__AFG99567

SEQ ID NO: 191619 - RNA, 1701 nt, Artificial Sequence; identical to SEQ ID NO: 191511
  derived and/or modified sequence opt5 from hemagglutinin__InfluenzaA__AFG99578

SEQ ID NO: 191620 - RNA, 1701 nt, Artificial Sequence; identical to SEQ ID NO: 191511
  derived and/or modified sequence opt5 from hemagglutinin__InfluenzaA__AFG99589

SEQ ID NO: 191621 - RNA, 1701 nt, Artificial Sequence
  derived and/or modified sequence opt5 from hemagglutinin__InfluenzaA__AFG99600
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggguccuggaugggaaaaauuguacccucaucgacgcccugcugggagauccccauugcgacggcuuucagaacaaggagugggaucucuucguggaacgcagcaaagccuauuccaauuguuacccuuaugacguucccgauuacgcuucucugagaagccuuguggccuccagcgggacgcuggaguuuaccaacgaagacuucaauuggacaggagucgcucagucuggcgaguccuaugccugcaagcggggcagcgugaagucuuucuucucccgccucaacuggcugcacgagagcgauuacaaauauccugcgcuuaauguuaccaugcccaacaaugggaaguuugacaaacuguacaucuggggagugcaucacccuucuacagauagagaacaaaccucccucuacguccgggccagcggccgcgugacgguguccacaaagagaucucagcagaccgucauuccgaacaucgggagccggcccuggguucgcggacuguccagcagaauuucuaucuauuggacaauugugaaaccuggcgacauccugcucauuaauuccaccgggaaccugaucgcuccccggggauacuucaagauccgcauuggcaagagcucuaucaugagaagcgacgccccuauuggcaccuguuccucugagugcaucacacccaacgggagcauuccgaaugauaaaccuuuucagaacgugaaucggaucacguauggagcuuguccccgcuacgucaagcaaaacacccuuaaacuggccacaggcaugagaaaugugccugaaaagcagacccgggggaucuucggagcgauugccggcuuuaucgagaacgggugggagggaaugguugacggcugguauggcuucagacaccaaaauuccgaagggacaggacaggcugccgaucucaaaagcacccaggcugccauugaccagaucaacggcaagcugaaucgccuuauugagaaaacgaacgaaaaguuucaucagaucgagaaggaauuuucugagguggaggggcggauccaagaucuggaaaaauacgucgaggacacaaagauugaucucugguccuauaaugccgaacugcugguggcucucgagaaccagcacaccaucgaccugaccgauagcgaaaugaauaaacuuuucgagaagacaagaaaacagcugcgcgagaacgcggaagacaugggaaauggcugcuuuaagauuuaccauaagugugauaacgccugcaucgggucuauucggaacggcaccuacgaccacgacguuuauagagaugaggcucucaauaaccgcuuccagaucaaaggaguggaacugaaguccggcuacaaagacuggauucuuuggaucagcuuugccaucuccugcuuccugcucugugucgugcugcugggguuuauuaugugggccugccaaaagggaaauauccgguguaacauuugcaucuga

SEQ ID NO: 191622 - RNA, 1701 nt, Artificial Sequence; identical to SEQ ID NO: 191511
  derived and/or modified sequence opt5 from hemagglutinin__InfluenzaA__AFG99611

SEQ ID NO: 191623 - RNA, 1701 nt, Artificial Sequence; identical to SEQ ID NO: 191511
  derived and/or modified sequence opt5 from hemagglutinin__InfluenzaA__AFG99622

SEQ ID NO: 191624 - RNA, 1701 nt, Artificial Sequence; identical to SEQ ID NO: 191511
  derived and/or modified sequence opt5 from hemagglutinin__InfluenzaA__AFG99633

SEQ ID NO: 191625 - RNA, 1701 nt, Artificial Sequence
  derived and/or modified sequence opt5 from hemagglutinin__InfluenzaA__AFG99644
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacaggcagaauuugcgacuccccgcaccggauccuggaugggaaaaacuguacccucaucgacgcccugcugggagauccccauugcgacgauuuucagaauaaggagugggaccucuucgucgaacgcucuaaagccuauagcaacuguuacccuuaugaugugcccgacuacgcuucccugagaucucuuguugccgcuagcggcacgcuggaguuuauuaaugaagauuucaacuggaccgggguggcccaguccggagagagcuaugcgugcaagcggggcucugucaaguccuuuuucagccgccucaauuggcugcacgagucugaauacaaauauccugcccuuaacgugacaaugcccaauaacggcaaguuugacaaacuguacaucuggggaguucaucacccuuccaccgauagagagcagacaagccucuacgugcgggcuucugggcgcgucaccguguccacgaagagaagccagcagacagugauuccgaauaucggcucccggcccuggguccgcgggcugucuagcagaauuuccaucuauuggaccauuguuaaaccuggagacauccugcucaucaacagcacaggcaaccugauugcuccccggggguacuucaagauccgcaccggaaagucuuccauuaugagaagcgacgccccuaucggcaccuguucuagcgaaugcauuacacccaauggcuccaucccgaacgauaaaccuuuucagaaugugaaccggaucacguauggggccuguccccgcuacgugaagcaaaauacccuuaaacuggcgacaggaaugagaaacgucccugagaagcagacccggggcauuuucggggccaucgcuggauuuauugagaauggcugggaagggaugguggacggaugguauggcuucagacaccagaacucugagggcacagggcaggccgcugaucucaaaagcacccaagccgccaucgaccagauuaauggaaagcugaaccgccuuaucgaaaagacgaaugagaaguuucaucagaucgaaaaggaguucuccgagauugaaggccggauccaaaaccuggagaaauacguugaagauacaaagauugaccucuggagcuauaaugcugagcugcugguggcgcucgaaaaccagcacaccaucgaucugaccgacucugagaugaauaaacuuuucgagaagacaagaaaacagcugcgcgaaaacgccgaggauauggggaacggaugcuuuaagauuuaccauaagugugacaaugcuugcaucggcuccauucggaacgggaccuacgaucacgacgucuauagagacgaagcccucaauaaccgcuuccagaucaaaggcguggagcugaaaagcggauacaaagauuggauccuuuggauuucuuuugccaucuccugcuuccugcucuguguugugcugcugggcuuuauuaugugggcuugccaaaaggggaauauccgguguaacauuugcaucuga

SEQ ID NO: 191626 - RNA, 1701 nt, Artificial Sequence
  derived and/or modified sequence opt5 from hemagglutinin__InfluenzaA__AFG99655
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacaggcagaauuugcgacuccccgcaccggauccuggaugggaaaaacuguacccucaucgacgcccugcugggagauccccauugcgacgauuuucagaauaaggagugggaccucuucgucgaacgcucuaaagccuauagcaacuguuacccuuaugaugugcccgacuacgcuucccugagaucucuuguugccagcuccggcacgcuggaguuuauuaaugaagauuucaacuggaccgggguggcucagagcggagagucuuaugccugcaagcggggcuccgucaagagcuuuuucucucgccucaauuggcugcacgaguccgaauacaaauauccugcgcuuaacgugacaaugcccaauaacggcaaguuugacaaacuguacaucuggggaguucaucacccuagcaccgauagagagcagacaucucucuacgugcgggccuccgggcgcgucaccgugagcacgaagagaucccagcagacagugauuccgaauaucggcucucggcccuggguccgcgggcugagcuccagaauuagcaucuauuggaccauuguuaaaccuggagacauccugcucaucaacucuacaggcaaccugauugcuccccggggguacuucaagauccgcaccggaaaguccagcauuaugagaucugacgccccuaucggcaccuguagcuccgaaugcauuacacccaauggcucuaucccgaacgauaaaccuuuucagaaugugaaccggaucacguauggggcuuguccccgcuacgugaagcaaaauacccuuaaacuggccacaggaaugagaaacgucccugagaagcagacccggggcauuuucggggcgaucgccggauuuauugagaauggcugggaagggaugguggacggaugguauggcuucagacaccagaacagcgagggcacagggcaggcugccgaucucaaauccacccaagcugccaucgaccagauuaauggaaagcugaaccgccuuaucgagaaaacgaaugaaaaguuucaucagaucgaaaaggaguucagcgagauugaaggccggauccaagaucuggagaaauacguugaagacacaaagauugaucucuggucuuauaacgccgagcugcugguggcucucgaaaaucagcacaccaucgaccugaccgauuccgagaugaacaaacuuuucgagaagacaagaaaacagcugcgcgaaaaugcggaggacauggggaacggaugcuuuaagauuuaccauaagugugauaacgccugcaucggcagcauucggaaugggaccuacgaccacgacgucuauagagaugaagcucucaacaaucgcuuccagaucaaaggcguggagcugaagucuggauacaaagacuggauccuuuggauuuccuuugccaucagcugcuuccugcucuguguugugcugcugggcuuuauuaugugggccugccaaaaggggaacauccgguguaauauuugcaucuga

SEQ ID NO: 191627 - RNA, 1701 nt, Artificial Sequence; identical to SEQ ID NO: 191626
  derived and/or modified sequence opt5 from hemagglutinin__InfluenzaA__AFG99666

SEQ ID NO: 191628 - RNA, 1701 nt, Artificial Sequence; identical to SEQ ID NO: 185362
  derived and/or modified sequence opt5 from hemagglutinin__InfluenzaA__AFG99677

SEQ ID NO: 191629 - RNA, 1701 nt, Artificial Sequence; identical to SEQ ID NO: 191511
  derived and/or modified sequence opt5 from hemagglutinin__InfluenzaA__AFG99688

SEQ ID NO: 191630 - RNA, 1701 nt, Artificial Sequence
  derived and/or modified sequence opt5 from hemagglutinin__InfluenzaA__AFG99701
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaugccuauuccaacuguuacccuuaugacgugcccgauuacgcuucucugagaagccuuguugccuccagcgggacgcuggaguuuaccaaugaagacuucaacuggacaggaguggcucagucuggcgaguccuaugccugcaaacggggcagcgucaagucuuucuucucccgccucaauuggcugcacgagagcgauuacaaguauccugcgcuuaacgugaccaugcccaauaacgggaaauuugacaagcuguacauuuggggaguucaucacccuucuacagauagagaacaaaccucccucuacgugcgggccagcggccgcgucacgguguccacaaaaagaucucagcagaccgugaucccgaauauugggagccggcccuggguccgcggacuguccagcagaaucucuauuuauuggacaaucguuaagccuggcgacauucugcucaucaacuccaccgggaaccugaucgcuccccggggauacuucaaaauucgcaccggcaagagcucuaucaugagaagcgacgccccuauuggcacauguuccucugagugcaucacgcccaaugggagcauuccgaacgauaagccuuuucagaaugugaaccggaucaccuauggagcuuguccccgcuacgugaaacaaaauacacuuaagcuggccaccggcaugagaaacgucccugaaaaacagacacgggggaucuucggagcgauugccggcuuuaucgagaaugggugggagggaaugguggacggcugguauggcuucagacaccagaacuccgaagggaccggacaggcugccgaucucaagagcacgcaagcugccauugaccagaucaauggcaaacugaaccgccuuauugagaagacaaaugaaaaauuucaucagaucgagaaggaauuuucugagguugaggggcggauccaagaucuggaaaaguacguggaggacaccaaaauugaucucugguccuauaacgccgaacugcuggucgcucucgagaaucagcacaccaucgaccugacagauagcgaaaugaacaaacuuuucgagaagaccagaaagcagcugcgcgagaaugcggaagacaugggaaacggcugcuuuaaaauuuaccauaagugugauaacgccugcaucgggucuauucggaauggcacauacgaccacgacguguauagagaugaggcucucaacaaucgcuuccagaucaagggagccgaacugaaauccggcuacaaggacuggauucuuuggaucagcuuugccaucuccugcuuccugcucuguguugugcugcugggguuuauuaugugggcuugccaaaaaggaaacauccgguguaauauuugcaucuga

SEQ ID NO: 191631 - RNA, 1701 nt, Artificial Sequence
  derived and/or modified sequence opt5 from hemagglutinin__InfluenzaA__AFG99712
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugaggugcccgacuacgcuucucugagaagccuuguugccuccagcgggacgcuggaauuuaccaacgaggauuucaauuggacaggaguggcucagucuggcgaguccuaugccugcaagcggggcagcgucaaguccuuuuucucucgccucaacuggcugcacgaaagcgacuacaaauauccugcgcuuaaugugaccaugcccaacaaugggaaguuugauaaacuguacauuuggggaguucaucacccuucuacagacagagagcaaaccucccucuacgugcgggccagcggccgcgucacgguguccacaaagagaucucagcagaccgugaucccgaacauugggagccggcccuggguccgcggacuguccagcagaaucucuauuuauuggacaaucguuaaaccuggcgauauucugcucaucaauuccaccgggaaccugaucgcuccccggggauacuucaagauucgcaccggcaagagcucuaucaugagaagcgacgccccuauuggcacauguuccucugaaugcaucacgcccaacgggagcauuccgaaugacaaaccuuuucagaacgugaaucggaucaccuauggagcuuguccccgcuacgugaagcaaaacacacuuaaacuggccaccggcaugagaaaugucccugagaagcagacacgggggaucuucggagcgauugccggcuuuaucgagaacgggugggaaggaaugguggauggcugguauggcuucagacaccaaaauuccgaggggaccggacaggcugccgaccucaaaagcacgcaggcugccauugaucagaucaacggcaagcugaaucgccuuauugagaaaacaaacgaaaaguuucaucagaucgaaaaggaguucucugagguugaagggcggauccaagaccuggagaaauacguggaagauaccaagauugaccucugguccuauaaugccgagcugcuggucgcucucgaaaaccagcacaccaucgaucugacagacagcgagaugaauaaacuuuucgagaagaccagaaaacagcugcgcgaaaacgcggaggauaugggaaauggcugcuuuaagauuuaccauaagugugacaacgccugcaucgggucuauucggaacggcacauacgaucacgacguguauagagacgaagcucucaauaaccgcuuccagaucaaaggaguugagcugaaguccggcuacaaagauuggauucuuuggaucagcuuugccaucuccugcuuccugcucugugugguccugcugggguuuauuaugugggccugccaaaagggaaauauccgguguaacauuugcaucuga

SEQ ID NO: 191632 - RNA, 1701 nt, Artificial Sequence; identical to SEQ ID NO: 191511
  derived and/or modified sequence opt5 from hemagglutinin__InfluenzaA__AFG99723

SEQ ID NO: 191633 - RNA, 1701 nt, Artificial Sequence; identical to SEQ ID NO: 191626
  derived and/or modified sequence opt5 from hemagglutinin__InfluenzaA__AFG99734

SEQ ID NO: 191634 - RNA, 1701 nt, Artificial Sequence
  derived and/or modified sequence opt5 from hemagglutinin__InfluenzaA__AFG99745
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgauuccuaugccugcaagcggggcagcgucaaguccuuuuucucucgccucaacuggcugcacgagagcgaguacaaauauccugcgcuuaaugugacaaugcccaacaaugacaaguuugauaaacuguacaucuggggaguucaucacccuucuaccgaaagagagcaaacaucccucuacauucgggccagcgggcgcgugaccgucuccacgaagagaucucagcagacagugaucccgaacauuggcagcaaacccugggugcgggggcuguccagccgcaucucuauuuauuggaccaucgucaagccuggagacauccugcucauuaauuccacaggcaaccugaucgcucccagaggguacuucaagauucggaccggaaaaagcucuaucaugcgcagcgacgccccuauuggcaccuguuccucugaaugcaucacacccaacggcagcaucccgaaugauaagccuuuucagaacguuaauagaauuacguauggggcuuguccccgguacgugaaacaaaacacccuuaagcuggccacaggaaugcgcaaugugccugagaaacagaccagaggcaucuucggggcgauugccggauuuaucgagaacggcugggaagggauggucgacggaugguauggcuuccggcaccaaaauuccgagggcacagggcaggcugccgaucucaagagcacccaggcugccauugaccagaucaacggaaaacugaauagacuuaucgaaaagacgaacgagaaguuucaucagauugaaaaagaguucucugagguggaaggccgcauccaagaucuggagaaguacguugaagacacaaaaauugaucucugguccuauaaugccgagcugcugguggcucucgaaaaccagcacaccaucgaccugaccgauagcgagaugaauaaacuuuucgagaagacacggaagcagcugagagaaaacgcggaggacauggggaauggaugcuuuaagauuuaccauaaaugugauaacgccugcaugggcucuauccgcaacgggaccuacgaccacgacgucuaucgggaugaagcucucaauaacagauuccagauuaagggcguggagcugaaauccggauacaaggacuggauccuuuggaucagcuuugccauuuccugcuuccugcucuguguugugcugcugggcuuuaucaugugggccugccaaaaagggaauauucgcuguaacaucugcauuuga

SEQ ID NO: 191635 - RNA, 1701 nt, Artificial Sequence; identical to SEQ ID NO: 191511
  derived and/or modified sequence opt5 from hemagglutinin__InfluenzaA__AFG99756

SEQ ID NO: 191636 - RNA, 1701 nt, Artificial Sequence
  derived and/or modified sequence opt5 from hemagglutinin__InfluenzaA__AFG99767
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacgauuuucagaacaaggagugggaccucuucgucgaacgcagcaaagccuauuccaauuguuacccuuaugaugugcccgacuacgcuucucugagaagccuuguugccuccagcggcacgcuggaguuuauuaacgaagauuucaauuggaccgggguggcucagucuggagaguccuaugccugcaagcggggcagcgucaaguccuuuuucucucgccucaacuggcugcacgagagcgaauacaaauauccugcgcuuaaugugacaaugcccaacaaugacaaguuugauaaacuguacaucuggggcguucaucacccuucuaccgacagagagcaaacaucccucuacauucgggccagcgggcgcgugaccgucuccacgaagagaucucagcagacagugaucccgaacauuggaagccggcccugggugcgcggccuguccagcagaaucucuauuuauuggaccaucgucaaaccuggggacauccugcucauuaauuccacaggaaaccugaucgcuccccggggcuacuucaagauucgcaccgggaaaagcucuaucaugagaagcgaugccccuauuggaaccuguuccucugaaugcaucacacccaacggcagcaucccgaaugacaaaccuuuucagaacguuaaucggauuacguauggcgcuuguccccgcuacgugaagcaaaacacccuuaaacuggccacagggaugagaaaugugccugagaagcagacccggggaaucuucggcgcgauugccggguuuaucgagaacggaugggaaggcauggucgaugggugguauggauucagacaccaaaauuccgagggcacaggccaggcugccgaccucaaaagcacccaggcugccauugaucagaucaacgggaagcugaaucgccuuaucgaaaagacgaacgagaaguuucaucagauugaaaaggaguucucugagguggaaggacggauccaagaccuggagaaauacguugaagauacaaagauugaccucugguccuauaaugccgagcugcugguggcucucgaaaaccagcacaccaucgaucugaccgacagcgagaugaauaaacuuuucgagaagacaagaaaacagcugcgcgaaaacgcggaggauaugggcaaugggugcuuuaagauuuaccauaagugugacaacgccugcaucggaucuauucggaacggcaccuacgaccacgaugucuauagagacgaagcucucaauaaccgcuuccagaucaaagggguggagcugaaguccggcuacaaagauuggauccuuuggauuagcuuugccaucuccugcuuccugcucuguguugugcugcugggauuuauuaugugggccugccaaaagggcaauauccgguguaacauuugcaucuga

SEQ ID NO: 191637 - RNA, 1701 nt, Artificial Sequence
  derived and/or modified sequence opt5 from hemagglutinin__InfluenzaA__AFG99778
augaagaccaucauugcccugagcuacauccucugccugguguucgcucagaaacuucccggcaacgacaauuccacagccacgcugugucucgggcaccaugcggucccuaacggaacccugguuaagacacuuaccaaugaucaaauugaggugacaaacgcuaccgaacuggugcagucuagcuccacaggcaaaaucugcgacucuccgcaccggauucucgaugggaagaauuguacccugaucgacgcccugcucggagauccccauugcgacggccugcagaacaaagagugggaucuuuuugucgaaagaagcaaggccuauuccaauuguuacccuuaugacgugcccgauuacgcuucucugcgcagccucguugccuccagcgggacgcuggaguucaucaacgaagacuuuaauuggaccggaguggcucaggauggcggcucuuaugccugcaagagaggguccgucaacagcuucuuuucucggcuuaauuggcugcacaaauccgaguacaaguauccugcgcucaacgugacaaugcccaauaacggaaaaguugacaagcuguacauuuggggcgugcaucacccuagcaccgaucgcgaccaaacaucucuguacgucagagccuccgggcgggugaccgugagcacgaaacgcucccagcagacagucaucccgaauauuggaucuagacccuggguucggggccagagcucccgcaucagcauuuauuggaccaucgugaagccuggggacauucuccugaucaacucuacaggaaaccuuaucgcucccagaggcuacuucaagauucggaauggcaaauccagcaucaugcgcucugaugccccuauugggaccuguagcuccgagugcaucacccccaacggaucuauuccgaaugacaagccuuuucaaaacgugaauagaaucacauauggcgcuuguccccgguacgucaaacagaacacgcugaagcucgccaccgggaugcgcaaugugccugaaaaacagacaagaggaaucuucggcgcgauugccggguuuaucgagaacggaugggaaggcaugguugauggcugguauggguuccggcaccagaauagcgagggaaccggccaagcugccgaccugaaguccacacaggcugccauugaucagaucaacgggaaacuuaauagacugauugagaagaccaacgaaaaguuucaucaaaucgagaaagaguucagcgaaguggaaggacgcauccaggaccucgagaaguacgucgaggauacgaaaauugaccuguggucuuauaaugccgaacugcucguggcucuggagaaccagcacacaaucgaucuuaccgacuccgaaaugaauaagcuguuugagaaaacccggaagcagcucagagaaaacgcggaggauaugggcaacgggugcuucaagauuuaccauaaaugugacaaugccugcaucggcagcauucgcaacggaacauacgaccacgauguuuaucgggacgaggcucugaauaacagauuccaaaucaagggcguggaacuuaaaucuggguacaaggauuggauucuguggaucuccuuugccaucagcugcuuccuccugugugucgugcugcucggauuuauuaugugggccugccagaaaggcaauauccgcuguaacauuugcaucuga

SEQ ID NO: 191638 - RNA, 1701 nt, Artificial Sequence; identical to SEQ ID NO: 191511
  derived and/or modified sequence opt5 from hemagglutinin__InfluenzaA__AFG99789

SEQ ID NO: 191639 - RNA, 1701 nt, Artificial Sequence; identical to SEQ ID NO: 191626
  derived and/or modified sequence opt5 from hemagglutinin__InfluenzaA__AFG99800

SEQ ID NO: 191640 - RNA, 1701 nt, Artificial Sequence
  derived and/or modified sequence opt5 from hemagglutinin__InfluenzaA__AFG99811
augaagaccaucauugcccugagcuacauccucugccugguguucucccagaaacuucccggcaacgacaauucuacagcuacgcugugucucgggcaccaugccgucccuaacggaacccugguuaagacaauuaccaaugaucaaaucgaggugacaaacgcgaccgaacuugugcagaauagcuccacaggcagaauuugcgacucuccgcaccggauccuggaugggaaaaacuguacccucaucgacgcucugcugggagauccccauugcgacgauuuucagaauaaggagugggaccucuucgucgaacgcagcaaagccuauuccaacuguuacccuuaugaugugcccgacuacgccucucugagaagccuuguugcuuccagcggcacgcuggaguuuauuaaugaagauuucaacuggaccgggguggcccagucuggagaguccuaugcuugcaagcggggcagcgucaaguccuuuuucucucgccucaauuggcugcacgagagcgaauacaaauauccugcccuuaacgugacaaugcccaauaacggcaaguuugacaaacuguacaucuggggaguucaucacccuucuaccgauagagagcaaacaucccucuacgugcgggcgagcgggcgcgucaccguguccacgaagagaucucagcagacagugauuccgaauaucggcagccggcccuggguccgcgggcuguccagcagaauuucuaucuauuggaccauuguuaaaccuggagacauccugcucaucaacuccacaggcaaccugauugcuccccggggguacuucaagauccgcaccggaaagagcucuauuaugagaagcgacgccccuaucggcaccuguuccucugaaugcauuacacccaauggcagcaucccgaacgauaaaccuuuucagaaugugaaccggaucacguauggggccuguccccgcuacgugaagcaaaauacccuuaaacuggcuacaggaaugagaaacgucccugagaagcagacccggggcauuuucggggccaucgcgggauuuauugagaauggcugggaagggaugguggacggaugguauggcuucagacaccagaacuccgagggcacagggcaggccgcugaucucaaaagcacccaagccgcuaucgaccagauuaauggaaagcugaaccgccuuaucgagaaaacgaaugaaaaguuucaucagaucgaaaaggaguucucugagauugaaggccggauccaagaucuggagaaauacguugaagacacaaagauugaucucugguccuauaacgccgagcugcugguggcccucgaaaaucagcacaccaucgaccugaccgauagcgagaugaacaaacuuuucgagaagacaagaaaacagcugcgcgaaaaugcugaggacauggggaacggaugcuuuaagauuuaccauaagugugauaacgcgugcaucggcucuauucggaaugggaccuacgaccacgacgucuauagagaugaagcccucaacaaucgcuuccagaucaaaggcguggagcugaaguccggauacaaagacuggauccuuuggauuagcuuugcuaucuccugcuuccugcucuguguugugcugcugggcuuuauuaugugggccugccaaaaggggaacauccgguguaauauuugcaucuga

SEQ ID NO: 191641 - RNA, 1701 nt, Artificial Sequence; identical to SEQ ID NO: 191511
  derived and/or modified sequence opt5 from hemagglutinin__InfluenzaA__AFG99822

SEQ ID NO: 191642 - RNA, 1701 nt, Artificial Sequence; identical to SEQ ID NO: 191511
  derived and/or modified sequence opt5 from hemagglutinin__InfluenzaA__AFG99833

SEQ ID NO: 191643 - RNA, 1701 nt, Artificial Sequence; identical to SEQ ID NO: 191511
  derived and/or modified sequence opt5 from hemagglutinin__InfluenzaA__AFG99844

SEQ ID NO: 191644 - RNA, 1701 nt, Artificial Sequence
  derived and/or modified sequence opt5 from hemagglutinin__InfluenzaA__AFG99855
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaagacuucaauuggacaggaguggcucagucuggcgaguccuaugccugcaagcggggcagcgucaaguccuuuuucucucgccucaacuggcugcacgagagcgauuacaaauauccugcgcuuaaugugaccaugcccaacaaugggaaguuugacaaacuguacauuuggggaguucaucacccuucuacagauagagaacaaaccucccucuacgugcgggccagcggccgcgucacgguguccacaaagagaucucagcagaccgugaucccgaacauugggagccggcccuggguccgcggacuguccagcagaaucucuauuuauuggacaaucguuaaaccuggcgacauucugcucaucaauuccaccgggaaccugaucgcuccccggggauacuucaagauucgcaccggcaagagcucuaucaugagaagcgacgccccuauuggcacauguuccucugagugcaucacgcccaacgggagcauuccgaaugauaaaccuuuucagaacgugaaucggaucaccuauggagcuuguccccgcuacgugaagcaaaacacacuuaaacuggccaccggcaugagaaaugucccugggaagcagacacggggaaucuucggcgcgauugccggguuuaucgaaaacggaugggagggcaugguggacggcugguauggguucagacaccaaaauuccgagggaaccggccaggcugccgaucucaaaagcacgcaggcugccauugaccagaucaacgggaagcugaaucgccuuauugagaaaacaaacgaaaaguuucaucagaucgaaaaggaguucucugaaguugagggacggauccaagaucuggagaaauacguggaagacaccaagauugaucucugguccuauaaugccgagcugcuggucgcucucgaaaaccagcacaccaucgaccugacagauagcgagaugaauaaacuuuucgaaaagaccagaaaacagcugcgcgagaacgcggaggacaugggcaaugggugcuuuaagauuuaccauaagugugauaacgccugcaucggcucuauucggaacggaacauacgaccacgacguguauagagaugaagcucucaauaaccgcuuccagaucaaaggcguugagcugaaguccggguacaaagacuggauucuuuggaucagcuuugccaucuccugcuuccugcucugugugguccugcugggauuuauuaugugggccugccaaaagggcaauauccgguguaacauuugcaucuga

SEQ ID NO: 191645 - RNA, 1701 nt, Artificial Sequence; identical to SEQ ID NO: 191511
  derived and/or modified sequence opt5 from hemagglutinin__InfluenzaA__AFG99866

SEQ ID NO: 191646 - RNA, 1701 nt, Artificial Sequence; identical to SEQ ID NO: 191511
  derived and/or modified sequence opt5 from hemagglutinin__InfluenzaA__AFG99877

SEQ ID NO: 191647 - RNA, 1701 nt, Artificial Sequence
  derived and/or modified sequence opt5 from hemagglutinin__InfluenzaA__AFG99888
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuaugccugcaagcggggcagcgucaaguccuuuuucucucgccucaacuggcugcacgagagcgaauacaaauauccugcgcuuaaugugacaaugcccaacaaugauaaguuugacaaacuguacaucuggggaguucaucacccuucuaccgauagagagcaaacaucccucuacauucgggccagcgggcgcgugaccgucuccacgaagagaucucagcagacagugaucccgaacauuggcagccggcccugggugcgcgggcuguccagcagaaucucuauuuauuggaccaucgucaaaccuggagacauccugcucauuaauuccacaggcaaccugaucgcuccccggggguacuucaagauucgcaccggaaagagcucuaucaugagaagcgacgccccuauuggcaccuguaacuccgaaugcaucacacccaauggcucuaucccgaacgauaaaccuuuucagaauguuaaccggauuacguauggggcuuguccccgcuacgugaagcaaaauacccuuaaacuggccacaggaaugagaaacgugccugagaagcagacccggggcaucuucggggcgauugccggauuuaucgagaauggcugggaagggauggucgacggaugguauggcuucagacaccagaacagcgagggcacagggcaggcugccgaucucaaauccacccaagcugccauugaccagaucaauggaaagcugaaccgccuuaucgagaaaacgaaugaaaaguuucaucagauugaaaaggaguucagcgagguggaaggccggauccaagaucuggagaaauacguugaagacacaaagauugaucucuggucuuauaacgccgagcugcugguggcucucgaaaaucagcacaccaucgaccugaccgauuccgagaugaacaaacuuuucgagaagacaagaaaacagcugcgcgaaaaugcggaggacauggggaacggaugcuuuaagauuuaccauaagugugauaacgccugcaucggcagcauucggaaugggaccuacaaccacgacgucuauagagacgaagcucucaauaaccgcuuccagaucaaaggcguggagcugaagucuggauacaaagauuggauccuuuggauuuccuuugccaucagcugcuuccugcucuguguugugcugcugggcuuuauuaugugggccugccaaaaggggaauauccgguguaacauuugcaucuga

SEQ ID NO: 191648 - RNA, 1701 nt, Artificial Sequence; identical to SEQ ID NO: 191511
  derived and/or modified sequence opt5 from hemagglutinin__InfluenzaA__AFG99899

SEQ ID NO: 191649 - RNA, 1701 nt, Artificial Sequence; identical to SEQ ID NO: 191511
  derived and/or modified sequence opt5 from hemagglutinin__InfluenzaA__AFG99910

SEQ ID NO: 191650 - RNA, 1701 nt, Artificial Sequence; identical to SEQ ID NO: 191511
  derived and/or modified sequence opt5 from hemagglutinin__InfluenzaA__AFG99921

SEQ ID NO: 191651 - RNA, 1701 nt, Artificial Sequence
  derived and/or modified sequence opt5 from hemagglutinin__InfluenzaA__AFG99932
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuaugccugcaagcggggcagcgucaaguccuuuuucucucgccucaacuggcugcacgagagcgaauacaaauauccugcgcuuaaugugacaaugcccaacaaugauaaguuugacaaacuguacaucuggggaguucaucacccuucuaccgauagagagcaaacaucccucuacauucgggccagcgggcgcgugaccgucuccacgaagagaucucagcagacagugaucccgaacauuggcagccggcccugggugcgcgggcuguccagcagaaucucuauuuauuggaccaucgucaaaccuggagacauccugcucauuaauuccacaggcaaccugaucgcuccccggggguacuucaagauucgcaccggaaagagcucuaucaugagaagcgacgccccuauuggcaccuguuccucugaaugcaucacacccaacggcagcaucccgaaugauaaaccuuuucagaacguuaaucggauuacguauggggcuuguccccgcuacgugaagcaaaacacccuuaaacuggccacaggaaugagaaaugugccugagaagcagacccggggcaucuucggggcgauugccggauuuaucgagaacggcugggaagggauggucgacggaugguauggcuucagacaccaaaauuccgagggcacagggcaggcugccgaucucaaaagcacccaggcugccauugaccagaucaacggaaagcugaaucgccuuaucgagaaaacgaacgaaaaguuucaucagauugaaaaggaguucucugagguggaaggccggauccaagaucuggagaaauacguugaagacacaaagauugaucucugguccuauaaugccgagcugcugguggcucucgaaaaccagcacaccaucgaccugaccgauagcgagaugaauaaacuuuucgagaagacaagaaaacagcugcgcgaaaacgcggaggacauggggaauggaugcuuuaagauuuaccauaagugugauaacgccugcaucggcucuauucggaacgggaccuacgaccacgacgucuauagagaugaagcucucaauaaccgcuuccagaucaaaggcguggagcugaaguccggauacaaagacuggauccuuuggauuagcuuugccaucuccugcuuccugcucuguguugugcugcugggcuuuauuaugugggccugccaaaaggggaauauccgguguaacauuugcaucuga

SEQ ID NO: 191652 - RNA, 1701 nt, Artificial Sequence; identical to SEQ ID NO: 191511
  derived and/or modified sequence opt5 from hemagglutinin__InfluenzaA__AFG99943

SEQ ID NO: 191653 - RNA, 1701 nt, Artificial Sequence
  derived and/or modified sequence opt5 from hemagglutinin__InfluenzaA__AFG99954
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgauuccuaugccugcaagcggggcagcgucaaguccuuuuucucucgccucaacuggcugcacgagagcgaguacaaauauccugcgcuuaaugugacaaugcccaacaaugacaaguuugauaaacuguacaucuggggaguucaucacccuucuaccgaaagagagcaaacaucccucuacauucgggccagcgggcgcgugaccgucuccacgaagagaucucagcagacagugaucccgaacauuggcuucaaacccugggugcgggggcugagcucccgcaucagcauuuauuggaccaucgucaagccuggagacauccugcucauuaauucuacaggcaaccugaucgcucccagaggguacuuuaagauucggaccggaaaauccagcaucaugcgcucugacgccccuauuggcaccuguagcuccgaaugcaucacacccaacggcucuaucccgaaugauaagccuuuccagaacguuaauagaauuacguauggggcuuguccccgguacgugaaacaaaacacccuuaagcuggccacaggaaugcgcaaugugccugagaaacagaccagaggcaucuuuggggcgauugccggauucaucgagaacggcugggaagggauggucgacggaugguauggcuuucggcaccagaauagcgagggcacagggcaggcugccgaucucaaguccacccaagcugccauugaccagaucaacggaaaacugaauagacuuaucgaaaagacgaacgagaaguuccaucagauugaaaaagaguucagcgagguggaaggccgcauccaagaucuggagaaguacguugaagacacaaaaauugaucucuggucuuauaaugccgagcugcugguggcucucgaaaaccagcacaccaucgaccugaccgauuccgagaugaauaaacuuuuugagaagacacggaagcagcugagagaaaacgcggaggacauggggaauggaugcuucaagauuuaccauaaaugugauaacgccugcaucggcagcauucgcaacgggaccuacgaccacgacgucuaucgggaugaagcucucaauaacagauuucagaucaagggcguggagcugaaaucuggauacaaggacuggauccuuuggauuuccuucgccaucagcugcuuucugcucuguguugugcugcugggcuucauuaugugggccugccaaaaagggaauauccgcuguaacauuugcaucuga

SEQ ID NO: 191654 - RNA, 1701 nt, Artificial Sequence
  derived and/or modified sequence opt5 from hemagglutinin__InfluenzaA__AFG99965
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucguggaacgcagcaaagccuauuccaauuguuacccuuaugacguccccgauuacgccucucugagaagccuuguggcuuccagcgggacgcuggaguuuaccaacgaagacuucaauuggacaggaguugcccagucuggcgaguccuaugcgugcaagcggggcagcgugaagucuuucuucucccgccucaacuggcugcacgagagcgauuacaaauauccugcccuuaaugucaccaugcccaacaaugggaaguuugacaaacuguacauuuggggagugcaucacccuucuacagauagagaacaaaccucccucuacguucgggcuagcggccgcgugacggucuccacaaagagaucucagcagaccgugaucccgaacauugggagccggcccugggugcgcggacuguccagcagaaucucuauuuauuggacaaucgucaaaccuggcgacauucugcucaucaauuccaccgggaaccugaucgcuccccggggauacuucaagauucgcaccggcaagagcucuaucaugagaagcgacgcuccuauuggcacauguuccucugagugcaucacgcccaacgggagcauuccgaaugauaaaccuuuucagaacguuaaucggaucaccuauggagccuguccccgcuacgugaagcaaaacacacuuaaacuggcgaccggcaugagaaaugugccugaaaagcagacacgggggaucuucggagccauugcuggcuuuaucgagaacgggugggagggaauggucgacggcugguauggcuucagacaccaaaauuccgaagggaccggacaggccgcugaucucaaaagcacgcaggccgccauugaccagaucaacggcaagcugaaucgccuuauugagaaaacaaacgaaaaguuucaucagaucgagaaggaauuuucugagguggaggggcggauccaagaucuggaaaaauacguugaggacaccaagauugaucucugguccuauaaugcugaacugcugguggcgcucgagaaccagcacaccaucgaccugacagauagcgaaaugaauaaacuuuucgagaagaccagaaaacagcugcgcgagaacgccgaagacaugggaaauggcugcuuuaagauuuaccauaagugugauaacgcuugcaucgggucuauucggaacggcacauacgaccacgacgucuauagagaugaggcccucaauaaccgcuuccagaucaaaggaguggaacugaaguccggcuacaaagacuggauucuuuggaucagcuuugccaucuccugcuuccugcucuguguugugcugcugggguuuauuaugugggcuugccaaaagggaaauauccgguguaacauuugcaucuga

SEQ ID NO: 191655 - RNA, 1701 nt, Artificial Sequence; identical to SEQ ID NO: 191511
  derived and/or modified sequence opt5 from hemagglutinin__InfluenzaA__AFG99976

SEQ ID NO: 191656 - RNA, 1701 nt, Artificial Sequence
  derived and/or modified sequence opt5 from hemagglutinin__InfluenzaA__AFG99987
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagaacggcgauucuuaugccugcaagcggggcuccgucaagagcuuuuucucucgccucaauuggcugcacgaguccgaguacaaauauccugcgcuuaacgugacaaugcccaauaacgacaaguuugauaaacuguacaucuggggaguucaucacccuagcaccgacagagaacaaacaucucucuacauucgggccuccgggcgcgugaccgucagcacgaagagaucccagcagacagugaucccgaauauuggcucucggcccugggugcgcgggcugagcuccagaaucagcauuuauuggaccaucgucaaaccuggagacauccugcucauuaacucuacaggcaaccugaucgcuccccggggguacuucaagauucgcaccggaaaguccagcaucaugagaucugaugccccuauuggcaccuguagcuccgagugcaucacacccaauggcucuaucccgaacgacaaaccuuuucagaauguuaaccggauuacguauggggcuuguccccgcuacgugaagcaaaauacccuuaaacuggccacaggaaugagaaacgugccugaaaagcagacccggggcaucuucggggcgauugccggauuuaucgagaauggcugggaggggauggucgauggaugguauggcuucagacaccagaacagcgaaggcacagggcaggcugccgaccucaaauccacccaagcugccauugaucagaucaauggaaagcugaaccgccuuaucgagaaaacgaaugaaaaguuucaucagauugagaaggaguucagcgaaguggagggccggauccaagaccuggaaaaauacguugaggauacaaagauugaccucuggucuuauaacgccgaacugcugguggcucucgagaaucagcacaccaucgaucugaccgacuccgaaaugaacaaacuuuucgagaagacaagaaaacagcugcgcgagaaugcggaagauauggggaacggaugcuuuaagauuuaccauaagugugacaacgccugcaucggcagcauucggaaugggaccuacgaccacgaugucuauagagacgaggcucucaacaaucgcuuccagaucaaaggcguggaacugaagucuggauacaaagauuggauccuuuggauuuccuuugccaucagcugcuuccugcucuguguugugcugcugggcuuuauuaugugggccugccaaaaggggaacauccgguguaauauuugcaucuga

SEQ ID NO: 191657 - RNA, 1701 nt, Artificial Sequence
  derived and/or modified sequence opt5 from hemagglutinin__InfluenzaA__AFG99998
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugaccccgaauauuggaucuagacccuggguccggggccugagcucccgcaucagcauuuauuggacaaucguuaaaccuggggacauucuccugaucaacucuaccggaaaccuuaucgcucccagaggcuacuucaagauucggaauggcaaguccagcaucaugcgcucugaugccccuauugggaacuguagcuccgagugcaucacccccaauggaucuauuccgaacgacaaaccuuuucagaaugugaacagaaucacauauggcgcuuguccccgguacgugaagcaaaauacgcugaaacucgccaccgggaugcgcaacgucccugaaaagcagacaagaggaaucuucggcgcgauugccggguuuaucgagaauggaugggaaggcaugguggauggcugguauggguuccggcaccagaacagcgagggaaccggccaggcugccgaccugaaauccacacaagcugccauugaucagaucaaugggaaacuuaacagacugauugagaagaccaaugaaaaguuucaucagaucgagaaggaguucagcgaaguugaaggacgcauccaagaccucgagaaauacguggaggauacgaagauugaccuguggucuuauaacgccgaacugcucgucgcucuggagaaucagcacacaaucgaucuuaccgacuccgaaaugaacaaacuguucgagaagacccggaaacagcucagagaaaacgcggaggauaugggcaaugggugcuuuaagauuuaccauaagugugacaacgccugcaucggcagcauucgcaauggaacauacgaccacgauguguaucgggacgaggcucugaacaauagauuccagaucaaaggcguugaacuuaagucuggguacaaagauuggauucuguggaucuccuuugccaucagcugcuuccuccugugugugguccugcucggauuuauuaugugggccugccaaaagggcaacauccgcuguaauauuugcaucuga

SEQ ID NO: 191658 - RNA, 1701 nt, Artificial Sequence; identical to SEQ ID NO: 191626
  derived and/or modified sequence opt5 from hemagglutinin__InfluenzaA__AFH00021

SEQ ID NO: 191659 - RNA, 1701 nt, Artificial Sequence
  derived and/or modified sequence opt5 from hemagglutinin__InfluenzaA__AFH00032
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcacagaauccuggaugggaagaauuguacccucaucgacgcccugcugggagauccccauugcgacgauuuucagaacaaagagugggaccucuucgucgaacggagcaaggccuauuccaauuguuacccuuaugaugugcccgacuacgcuucucugcgcagccuuguugccuccagcggcacgcuggaguuuauuaacgaagauuucaauuggaccgggguggcucagucuggagacuccuaugccugcaagagaggcagcgucaaaucuuucuucucccggcucaacuggcugcacgagagcgaguacaaguauccugcgcuuaaugugacaaugcccaacaaugauaaauuugacaagcuguacaucuggggcguucaucacccuucuaccgaccgcgaacaaacaucccucuacauuagagccagcgggcgggugaccgucuccacgaaacgcucucagcagacagugaucccgaacauuggaagcagacccugggugcggggccuguccagccgcaucucuauuuauuggaccaucgucaagccuggggauauccugcucauuaauuccacaggaaaccugaucgcucccagaggcuacuucaagauucggaccgggaaaagcucuaucaugcgcagcgacgccccuauuggaaccuguuccucugagugcaucacacccaacggcagcaucccgaaugauaagccuuuucagaacguuaauagaauuacguauggcgcuuguccccgguacgugaaacaaaacacccuuaagcuggccacagggaugcgcaaugugccugaaaaacagaccagaggaaucuucggcgcgauugccggguuuaucgagaacggaugggagggcauggucgacgggugguauggauuccggcaccaaaauuccgaaggcacaggccaggcugccgaucucaagagcacccaggcugccauugaccagaucaacgggaaacugaauaaacuuaucgagaagacgaacgaaaaguuucaucagauugagaaggaauuuucugagguggagggaagaauccaagaucuggaaaaauacguugaggacacaaagauugaucucugguccuauaaugccgaacugcugguggcucucgagaaccagcacaccaucgaccugaccgauagcgaaaugaauaaacuuuucgagaagacacgcaagcagcugcgggagaacgcggaagacaugggcaaugggugcuuuaaaauuuaccauaagugugacaacgccugcaucggaucuauuagaaacggcaccuacgaucacgacgucuaucgcgaugaggcucucaauaaccgguuccagaucaaagggguggaacugaaguccggcuacaaagacuggauccuuuggauuagcuuugccaucuccugcuuccugcucuguguugugcugcugggauuuauuaugugggccugccaaaagggcaauaucagauguaacauuugcaucuga

SEQ ID NO: 191660 - RNA, 1701 nt, Artificial Sequence
  derived and/or modified sequence opt5 from hemagglutinin__InfluenzaA__AFH00043
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcacagaauccuggaugggaagaauuguacccucaucgacgcccugcugggagauccccauugcgacgauuuucagaacaaagagugggaccucuucgucgaacggagcaaggccuauuccaauuguuacccuuaugaugugcccgacuacgcuucucugcgcagccuuguugccuccagcggcacgcuggaguuuauuaacgaagauuucaauuggaccgggguggcucagucuggagacuccuaugccugcaagagaggcagcgucaaaucuuucuucucccggcucaacuggcugcacgagagcgaguacaaguauccugcgcuuaaugugacaaugcccaacaaugauaaauuugacaagcuguacaucuggggcguucaucacccuucuaccgaccgcgaacaaacaucccucuacauuagagccagcgggcgggugaccgucuccacgaaacgcucucagcagacagugaucccgaacauuggaagcagacccugggugcggggccuguccagccgcaucucuauuuauuggaccaucgucaagccuggggauauccugcucauuaauuccacaggaaaccugaucgcucccagaggcuacuucaagauucggaccgggaaaagcucuaucaugcgcagcgacgccaccauuggaacauguuccucugagugcaucacgccuaacggcagcauccccaaugauaagccguuucagaacguuaauagaauuaccuauggcgcuuguccucgguacgugaaacaaaacacacuuaagcuggccaccgggaugcgcaaugugcccgaaaaacagacaagaggaaucuucggcgcgauugccggguuuaucgagaacggaugggagggcauggucgacgggugguauggauuccggcaccaaaauuccgaaggcaccggccaggcugccgaucucaagagcacgcaggcugccauugaccagaucaacgggaaacugaauaaacuuaucgagaagacaaacgaaaaguuucaucagauugagaaggaauuuucugagguggagggaagaauccaagaucuggaaaaauacguugaggacaccaagauugaucucugguccuauaaugccgaacugcugguggcucucgagaaccagcacaccaucgaccugacagauagcgaaaugaauaaacuuuucgagaagacccgcaagcagcugcgggagaacgcggaagacaugggcaaugggugcuuuaaaauuuaccauaagugugacaacgccugcaucggaucuauuagaaacggcacauacgaucacgacgucuaucgcgaugaggcucucaauaaccgguuccagaucaaagggguggaacugaaguccggcuacaaagacuggauccuuuggauuagcuuugccaucuccugcuuccugcucuguguugugcugcugggauuuauuaugugggccugccaaaagggcaauaucagauguaacauuugcaucuga

SEQ ID NO: 191661 - RNA, 1701 nt, Artificial Sequence
  derived and/or modified sequence opt5 from hemagglutinin__InfluenzaA__AFH00054
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagaacggcgauucuuaugccugcaagcggggcuccgucaagagcuuuuucucucgccucaauuggcugcacgaguccgaguacaaauauccugcgcuuaacgugacaaugcccaauaacgacaaguuugauaaacuguacaucuggggaguucaucacccuagcaccgacagagaacaaacaucucucuacauucgggccuccgggcgcgugaccgucagcacgaagagaucccagcagacagugaucccgaauauuggcucucggcccugggugcgcgggcugagcuccagaaucagcauuuauuggaccaucgucaaaccuggagacauccugcucauuaacucuacaggcaaccugaucgcuccccggggguacuucaagauucgcaccggaaaguccagcaucaugagaucugaugccccuauuggcaccuguagcuccgagugcaucacacccaauggcucuaucccgaacgacaaaccuuuucagaauguuaaccggauuacguauggggcuuguccccgcuacgugaagcaaaauacccuuaaacuggccacaggaaugagaaacgugccugaaaagcagacccggggcaucuucggggcgauugccggauuuaucgagaauggcugggaggggauggucgauggaugguauggcuucagacaccagaacagcgaaggcacagggcaggcugccgaccucaaauccacccaagcugccauugaucagaucaauggaaagcugaaccgccuuaucgagaaaacgaaugaaaaguuucaucagauugagaaggaguucagcgaaguggagggccggauccaagaccuggaaaaauacguugaggauacaaagauugaccucuggucuuauaacgccgaacugcugguggcucucgagaaucagcacaccaucgaucugaccgacuccgaaaugaacaaacuuuucgagaagacaagaaaacagcugcgcgagaaugcggaagauauggggaacggaugcuuuaagauuuaccauaagugugacaacgccugcaucggcagcauucggaaugggaccuacgaccacgaugucuauagagacgaggcucucaacaaucgcuuccacaucaaaggcguggaacugaagucuggauacaaagauuggauccuuuggauuuccuuugccaucagcugcuuccugcucuguguugugcugcugggcuuuauuaugugggccugccagaaggggaacauccgguguaauauuugcaucuga

SEQ ID NO: 191662 - RNA, 1701 nt, Artificial Sequence
  derived and/or modified sequence opt5 from hemagglutinin__InfluenzaA__AFH00065
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugauuccgaauaucggaucuagacccuggguccggggccagccuagccgcauuuccaucuauuggaccauuguuaaacccggggacauccugcucaucaacagcacaggaaaccugauugcuccuagaggcuacuucaagauccggaauggcaagucuuccauuaugcgcagcgaugcccccaucgggaacuguucuagcgagugcauuaccccgaauggauccaucccuaacgacaaacccuuucaaaaugugaacagaaucaccuauggcgcuuguccucgguacgugaagcagaauacacuuaaacuggccacggggaugcgcaacguccccgaaaagcagaccagaggaauuuucggcgcgaucgccggguuuauugagaauggaugggaaggcaugguggauggcugguauggguuccggcaccagaacucugagggaacaggccaagcugccgaccucaaaagcacccaggcugccaucgaucagauuaaugggaagcugaacagacuuaucgagaaaacaaaugaaaaguuucaucaaaucgagaaggaguucuccgaaguugaaggacgcauucaggaccuggagaaauacguggaggauaccaagaucgaccucuggagcuauaacgccgaacugcuggucgcucucgagaaucagcacacgauugaucugacagacucugaaaugaacaaacuuuucgagcggaccagaaagcagcugcgcgaaaacgcggaggauaugggcaaugggugcuuuaaaaucuaccauaagugugacaacgccugcauuggcuccauccggaauggaaccuacgaccacgauguguauagagacgaggcucucaacaaucgcuuccaaauuaagggcguugaacugaaaagcggguacaaggauuggauccuuuggaucucuuuugccauuuccugcuuccugcucugugugguccugcugggauuuaucaugugggccugccagaaaggcaacauucgguguaauaucugcauuuga

SEQ ID NO: 191663 - RNA, 1701 nt, Artificial Sequence
  derived and/or modified sequence opt5 from hemagglutinin__InfluenzaA__AFH00076
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcacagaauccuggaugggaagaauuguacccucaucgacgcccugcugggagauccccauugcgacgauuuucagaacaaagagugggaccucuucgucgaacggagcaaggccuauuccaauuguuacccuuaugaugugcccgacuacgcuucucugcgcagccuuguugccuccagcggcacgcuggaguuuauuaacgaagauuucaauuggaccgggguggcucagucuggagacuccuaugccugcaagagaggcagcgucaaaucuuucuucucccggcucaacuggcugcacgagagcgaguacaaguauccugcgcuuaaugugacaaugcccaacaaugauaaauuugacaagcuguacaucuggggcguucaucacccuucuaccgaccgcgaacaaacaucccucuacauuagagccagcgggcgggugaccgucuccacgaaacgcucucagcagacagugaucccgaacauuggaagcagacccugggugcggggccuguccagccgcaucucuauuuauuggaccaucgucaagccuggggauauccugcucauuaauuccacaggaaaccugaucgcucccagaggcuacuucaagauucggaccgggaaaagcucuaucaugcgcagcgacgccccuauuggaaccuguaacuccgagugcaucacacccaauggcucuaucccgaacgauaagccuuuucagaauguuaacagaauuacguauggcgcuuguccccgguacgugaaacaaaauacccuuaagcuggccacagggaugcgcaacgugccugaaaaacagaccagaggaaucuucggcgcgauugccggguuuaucgagaauggaugggagggcauggucgacgggugguauggauuccggcaccagaacagcgaaggcacaggccaggcugccgaucucaaguccacccaagcugccauugaccagaucaaugggaaacugaacagacuuaucgagaagacgaaugaaaaguuucaucagauugagaaagaauuuagcgagguggagggacgcauccaagaucuggaaaaguacguugaggacacaaaaauugaucucuggucuuauaacgccgaacugcugguggcucucgagaaucagcacaccaucgaccugaccgauuccgaaaugaacaaacuuuucgagaagacacggaagcagcugagagagaaugcggaagacaugggcaacgggugcuuuaagauuuaccauaaaugugacaacgccugcaucggaagcauucgcaauggcaccuacgaucacgacgucuaucgggaugaggcucucaacaauagauuccagaucaaggggguggaacugaaaucuggcuacaaggacuggauccuuuggauuuccuuugccaucagcugcuuccugcucuguguugugcugcugggauuuauuaugugggccugccaaaaaggcaacauccgcuguaauauuugcaucuga

SEQ ID NO: 191664 - RNA, 1701 nt, Artificial Sequence
  derived and/or modified sequence opt5 from hemagglutinin__InfluenzaA__AFH00087
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcgaggccuauuccucuuguuacccuuaugacgugcccgauuacgcuagccugagaucccuuguugccagcucugggacgcuggaauuuauuaaugaggacuucaacuggaccggaguggcucaggauggcaaauccuaugccugcaagcggggcagcgucaauuccuuuuucucucgccucaacuggcugcacaaacuugaguacaaguauccugcgcugaaugugacaaugcccaacaaugggaaguuugacaaacucuacaucuggggaguucaucacccuagcaccgauucugaccaaacaucccuguacgugagagccagcggccgggucaccguguccacgaagcgcucucagcagacagugauuccgaacaucgggagcagacccuggguccggggacaguccagccgcauuggcaucuauuggaccauuguuaaaccuggggacauccugcucaucaauucuacaggaaaccugauugcucccagaggcuacuucaagauccggaacggcaaguccagcauuaugcgcucugaugccccuaucgggaauuguagcuccgaaugcauuacccccaacggaucuaucccgaaugacaaaccuuuucaaaacgugaauaagaucaccuauggcgcuugucccagauacgugaaacagaacacacuuaagcuggccacggggaugcggaaugucccugagaaacagacccgcggaauuuucggcgcgaucgccggguuuauugaaaacggaugggagggcaugguggauggcugguauggguucagacaccagaauagcgagggaacaggccaagcugccgaccucaaguccacccaggcugccaucgaucagauuaacgggaaacugaaucggcuuaucgaaaagacaaacgagaaguuucaucaaaucgaaaaagaguucagcgaaguugagggacgcauucaggaccuggagaaguacguggaagauaccaaaaucgaccucuggucuuauaaugccgagcugcuggucgcucucgaaaaccagcacacgauugaucugacagacuccgagaugaauaaacuuuucgaaagaacccggaagcagcugagagagaacgcggaggauaugggcaacgggugcuuuaagaucuaccauaagugugacaaugccugcauuggcagcauccgcaacggaaccuacgaccacgauguguaucgggacgaagcucucaauaacagauuccaaauuaaaggcguugagcugaagucuggguacaaagauuggauccuuuggaucuccuuugccauuagcugcuuccugcucugugugguccugcugggauuuaucaugugggccugccagaagggcaauauucgcuguaacaucugcauuuga

SEQ ID NO: 191665 - RNA, 1701 nt, Artificial Sequence
  derived and/or modified sequence opt5 from hemagglutinin__InfluenzaA__AFH00098
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugauuccgaauaucggaucuagacccuggguccggggccugccuagccgcauuuccaucuauuggaccauuguuaaacccggggacauccuccugaucaacagcacaggaaaccuuauugcuccuagaggcuacuucaagauccggaauggcaagucuuccauuaugcgcagcgaugcccccaucgggaacuguucuagcgagugcauuaccccgaauggauccaucccuaacgacaaacccuuucagaaugugaacagaaucaccuauggcgcuuguccucgguacgugaagcaaaauacacugaaacucgccacggggaugcgcaacguccccgaaaagcagaccagaggaauuuucggcgcgaucgccggguuuauugagaauggaugggaaggcaugguggauggcugguauggguuccggcaccagaacucugagggaacaggccaggcugccgaccugaaaagcacccaagcugccaucgaucagauuaaugggaaacuuaacagacugaucgagaagacaaaugaaaaguuucaucagaucgagaaggaguucuccgaaguugaaggacgcauucaagaccucgagaaauacguggaggauaccaagaucgaccuguggagcuauaacgccgaacugcucgucgcucuggagaaucagcacacgauugaucuuacagacucugaaaugaacaaacuguucgagcggaccagaaagcagcuccgcgaaaacgcggaggauaugggcaaugggugcuuuaaaaucuaccauaagugugacaacgccugcauuggcuccauccggaauggaaccuacgaccacgauguguauagagacgaggcucugaacaaucgcuuccagauuaagggcguugaacuuaaaagcggguacaaggauuggauccuguggaucucuuuugccauuuccugcuuccuccugugugugguccugcucggauuuaucaugugggccugccaaaaaggcaacauucgguguaauaucugcauuuga

SEQ ID NO: 191666 - RNA, 1701 nt, Artificial Sequence
  derived and/or modified sequence opt5 from hemagglutinin__InfluenzaA__AFH00109
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuauacaugcaagcggggcuccgucaacagcuuuuucucucgccucaauuggcugcacaaacuugaguacaaguauccugcccugaacgugaccaugcccaauaacgggaaauuugacaagcucuacaucuggggaguucaucacccuuccacagauagcgaccaaaccucucuguacgugagagcguccggccgggucacggugagcacaaaacgcucccagcagaccgugauuccgaauaucggguucagacccuggguccggggacugucuagccgcauuuccaucuauuggacaauuguuaagccuggcgacauccuccugaucaacagcaccgggaaccuuauugcccccagaggauacuuuaagauccggaauggcaaaucuuccauuaugcgcagcgaugcuccuaucggcaacuguucuagcgagugcauuacccccaauggguccaucccgaacgacaagccuuuccagaaugugaacagaaucacauauggagccuguccccgguacgugaaacaaaauacgcugaagcucgcuaccggcaugcgcaacgucccugaaaaacagacaagagggauuuuuggagccaucgcgggcuucauugagaaugggugggaaggaaugguggauggcugguauggcuuucggcaccagaacucugaggggaccggacaggccgcugaccuuaagagcacacaagccgcuaucgaucagauuaauggcaaacugaacagacugaucgagaagaccaaugaaaaguuccaucagaucgagaaagaguucuccgaaguugaagggcgcauucaagaccucgagaaguacguggaggauacgaaaaucgaccuguggagcuauaacgccggacugcucgucgcccuggaaaaucagcacacaauugaucuuaccgacucugagaugaacaagcuguuugaacggaccagaaaacagcuccgcgagaacgcugaagauaugggcaaugggugcuucaagaucuaccauaagugugacaacgcgugcauuggcuccauccggaauggaacauacgaccacgauguguauagagacgaggcccugaacaaucgcuuucagauuaaaggcguugagcuuaagagcggguacaaagauuggauccuguggaucucuuucgcuauuuccugcuuucuccugugugugguccugcucggauucaucaugugggccugccaaaagggcaacauucgguguaauaucugcauuuga

SEQ ID NO: 191667 - RNA, 1701 nt, Artificial Sequence
  derived and/or modified sequence opt5 from hemagglutinin__InfluenzaA__AFH00120
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucgaucagauuaauggcaaacugaacagacugaucgagaagacaaaugaaaaguuccaucagaucgagaaagaguucuccgaaguugaagggcgcauucaagaccucgagaaguacguggaggauaccaaaaucgaccuguggagcuauaacgccggacugcucgucgcucuggaaaaucagcacacgauugaucuuacagacucugagaugaacaagcuguuugaacggaccagaaaacagcuccgcgagaacgcggaagauaugggcaaugggugcuucaagaucuaccauaagugugacaacgccugcauuggcuccauccggaauggaaccuacgaccacgauguguauagagacgaggcucugaacaaucgcuuucagauuaaaggcguugagcuuaagagcggguacaaagauuggauccuguggaucucuuucgccauuuccugcuuucuccugugugugguccugcucggauucacaaugugggccugccaaaagggcaacauccgguguaauauuugcaucuga

SEQ ID NO: 191668 - RNA, 1701 nt, Artificial Sequence; identical to SEQ ID NO: 191522
  derived and/or modified sequence opt5 from hemagglutinin__InfluenzaA__AFH00131

SEQ ID NO: 191669 - RNA, 1701 nt, Artificial Sequence
  derived and/or modified sequence opt5 from hemagglutinin__InfluenzaA__AFH00153
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacauuagagccuccggccgggugaccgucagcacgaaacgcucccagcagacagugaucccgaauauugggucuagacccugggugcggggacugagcucccgcaucagcauuuauuggaccaucgucaagccuggcgacauccuccugauuaacucuacagggaaccuuaucgcucccagaggauacuucaagauucggaauggcaaauccagcaucaugcgcucugaugccccuauuggcaacuguagcuccgagugcaucacccccaaugggucuaucccgaacgacaagccuuuucagaauguuaacagaauuaccuauggagcuuguccccgguacgugaaacaaaauacacugaagcucgccacgggcaugcgcaacgugccugaaaaacagaccagagggaucuucggagcgauugccggcuuuaucgagaaugggugggaaggaauggucgauggcugguauggcuuccggcaccagaacagcgaggggacaggacaggcugccgaccugaaguccacccaagcugccauugaucagaucaauggcaaacuuaacagacugaucgagaagacaaaugaaaaguuucaucagauugagaaagaguucagcgaaguggaagggcgcauccaagaccucgagaaguacguugaggauaccaaaauugaccuguggucuuauaacgccgaacugcucguggcucuggagaaucagcacacgaucgaucuuacagacuccgaaaugaacaagcuguucgagcggaccagaaaacagcuccgcgaaaacgcggaggauaugggaaauggcugcuuuaagauuuaccauaagugugacaacgccugcaucgggagcauucggaauggcaccuacgaccacgaugucuauagagacgaggcucugaacaaucgcuuccagaucaaaggaguggaacuuaagucuggcuacaaagauuggauccuguggauuuccuuugccaucagcugcuuccuccuguguguugugcugcucggguuuauuaugugggccugccaaaagggaaacauccgguguaauauuugcaucuga

SEQ ID NO: 191670 - RNA, 1701 nt, Artificial Sequence
  derived and/or modified sequence opt5 from hemagglutinin__InfluenzaA__AFH00164
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucauggacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaucaacgaagacuucaauuggaccggaguggcucagaacggcgauucuuaugccugcaagcggggcuccgucaagagcuuuuucucucgccucaauuggcugcacgaguccgaguacaaauauccugcgcuuaacgugacaaugcccaauaacgacaaguuugauaaacuguacauuuggggaguucaucacccuagcaccgacagagaacaaacaucucucuacauccgggccuccgggcgcgugaccgucagcacgaagagaucccagcagacagugauuccgaauaucggcucucggcccugggugcgcgggcugagcuccagaauuagcaucuauuggaccauugucaaaccuggagacauccugcucaucaacucuacaggcaaccugauugcuccccggggguacuucaagauccgcaccggaaaguccagcauuaugagaucugaugccccuaucggcaccuguagcuccgagugcauuacacccaauggcucuaucccgaacgacaaaccuuuucagaauguuaaccggaucacguauggggcuuguccccgcuacgugaagcaaaauacccuuaaacuggccacaggaaugagaaacgugccugaaaagcagacccggggcauuuucggggcgaucgccggauuuauugagaauggcugggaggggauggucgauggaugguauggcuucagacaccagaacagcgaaggcacagggcaggcugccgaccucaaauccacccaagcugccaucgaucagauuaauggaaagcugaaccgccuuaucgagaaaacgaaugaaaaguuucaucagaucgagaaggaguucagcgaaguggagggccggauucaagaccuggaaaaauacguugaggauacaaagaucgaccucuggucuuauaacgccgaacugcugguggcucucgagaaucagcacaccauugaucugaccgacuccgaaaugaacaaacuuuucgagaagacaagaaaacagcugcgcgagaaugcggaagauauggggaacggaugcuuuaagaucuaccauaagugugacaacgccugcauuggcagcauccggaaugggaccuacgaccacgaugucuauagagacgaggcucucaacaaucgcuuccagauuaaaggcguggaacugaagucuggauacaaagauuggauccuuuggaucuccuuugccauuagcugcuuccugcucuguguugugcugcugggcuuuaucaugugggccugccaaaaggggaacauucgguguaauaucugcauuuga

SEQ ID NO: 191671 - RNA, 1701 nt, Artificial Sequence
  derived and/or modified sequence opt5 from hemagglutinin__InfluenzaA__AFH00175
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaagagcuuuuucucucgccucaacuggcugcacaaacuugaguacaaauauccugcgcugaaugugacaaugcccaacaaugggaaguuugacaaacucuacaucuggggaguucaucacccuuccaccgauagcgaccaaacaucucuguacgugagagccuccggccgggucaccgugagcacgaagaagucccagcagacagugauuccgaacaucgggucucgccccugggucagaggacagagcucccggauuagcaucuauuggaccauuguuaaaccuggcgacauccugcucaucaauucuacagggaaccugauugcuccccgcggauacuucaagaucagaaacggcaaauccagcauuaugcggucugaugccccuaucggcaauuguagcuccgagugcauuacccccaacgggucuaucccgaaugacaagccuuuucaaaacgugaaucgcaucaccuauggagcuugucccagauacgugaaacagaacacacuuaagcuggccacgggcaugcggaaugucccugaaaaacagacccgcgggauuuucggagcgaucgccggcuuuauugagaacgggugggaaggaaugguggauggcugguauggcuucagacaccagaauagcgaggggacaggacaagcugccgaccucaaguccacccaggcugccaucgaucagauuaacggcaagcugaaucggcuuaucgagaaaacaaacgaaaaguuucaucaaaucgagaaagaguucagcgaaguugaagggcgcauucaggaccuggagaaguacguggaggauaccaaaaucgaccucuggucuuauaaugccgaacugcuggucgcucucgagaaccagcacacgauugaucugacagacuccgaaaugaauaaacuuuucgagagaacccggaagcagcugagagaaaacgcggaggauaugggaaacggcugcuuuaagaucuaccauaagugugacaaugccugcauugggagcauccgcaacggcaccuacgaccacgauguguaucgggacgaggcucucaauaacagauuccaaauuaaaggaguugaacugaagucuggcuacaaagauuggauccuuuggaucuccuuugccauuagcugcuuccugcucugugugguccugcugggguuuaucaugugggccugccagaagggaaauauucgcuguaacaucugcauuuga

SEQ ID NO: 191672 - RNA, 1701 nt, Artificial Sequence
  derived and/or modified sequence opt5 from hemagglutinin__InfluenzaA__AFH00186
augaagaccaucauugcccugagccacauccucugccugguguucgcucagaaacuucccggcaacgacaauuccacagccacgcugugucucgggcaucacgcggucccuaacggaacccugguuaagacaauuaccaaugaucaaaucgaggugacaaacgcuaccgaacuugugcagucuagcuccacaggcagaauuugcgacucuccgcaucggauccuggaugggaaaaauuguacccucaucgacgcccugcugggagauccccacugcgacggcuuucagaacaaggagugggaucucuucgucgaacgcagcaaagccuacuccaauuguuauccuuacgacgugcccgauuaugcuucucugagaagccuuguugccuccagcgggacgcuggaguuuauuaacgaagacuucaauuggaccggaguggcucaggauggcggcucuuacgccugcaagcggggguccgucaacagcuuuuucucucgccucaauuggcugcauaaacuugaguauaaguacccugcgcugaacgugacaaugcccaauaacggaaaguuugacaaacucuauaucuggggcguucaccacccuuccaccgauagcgaccaaacaucucuguacgugagagccuccgggcgggucaccgugagcacgaagcgcucccagcagacagugaccccgaauauuggaucuagacccuggguccggggccagagcucccgcaucagcauuuacuggacaaucguuaaaccuggggacauucugcucaucucuuccaccggaaaccugaucgcucccagaggcuauuucaagauucggaacggcaagagcucuaucaugcgcagcgaugugccuauugggaauuguuccucugagugcaucacccccaacggaagcauuccgaaugacaaaccuuuucaaaacgugaauagaaucacauacggcgccuguccccgguaugucaagcagaacacgcuuaaacuggcuaccgggaugcgcaaugugccugaaaagcagacaagaggaaucuucggcgccauugcgggguuuaucgagaacggaugggaaggcaugguugauggcugguacggguuccggcaucaaaauuccgagggaaccggccaggccgcugaccucaaaagcacacaggccgcuauugaucagaucaacgggaagcugaauagacuuauugagaaaaccaacgaaaaguuucaccaaaucgagaaggaguucucugaaguggaaggacgcauccaggaccuggagaaauaugucgaggauacgaagauugaccucugguccuacaaugccgaacugaucguggcccuggagaaccagcauacaauugaucucaccgacagcgaaaugaauaaacuguucgagaagacccggaaacagcuuagagaaaacgcugaggauaugggcaacgggugcuuuaagaucuaucacaagugugacaaugcgugcauuggcucuauccgcaacggaacauacgaccacgauguuuaccgggacgaggcccugaauaacagauuccaaauuaaaggcguggaacucaaguccggguauaaagauuggauccuguggaucagcuuugcuauuuccugcuuccuucugugugucgugcuccugggauuuaucaugugggccugccagaagggcaauauucgcuguaacaucugcauuuga

SEQ ID NO: 191673 - RNA, 1701 nt, Artificial Sequence
  derived and/or modified sequence opt5 from hemagglutinin__InfluenzaA__AFH00197
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuauacaugcaagcggggguccgucaacagcuuuuucucucgccucaauuggcugcacaaacuugaguacaaguauccugcccugaacgugaccaugcccaauaacggaaaguuugacaaacucuacaucuggggcguucaucacccuuccacagauagcgaccaaaccucucuguacgugagagcguccgggcgggucacggugagcacaaagauuucccagcagaccgugaucccgaauauuggaucucgccccugggucagaggccugagcucccggaucagcauuuauuggacaaucguuaaaccuggggacauccuccugauuaacucuaccggaaaccuuaucgcuccccgcggcuacuucaagauuagaaauggcaaguccagcaucaugcggucugaugccccuauugggaacuguagcuccgagugcaucacccccaauggaucuaucccgaacgacaaaccuuuucagaaugugaaccgcauuacauauggcgccugucccagauacgugaagcaaaauacgcugaaacucgcuaccgggaugcggaacgucccugaaaagcagacacgcggaaucuucggcgccauugcgggguuuaucgagaauggaugggaaggcaugguggauggcugguauggguucagacaccagaacagcgagggaaccggccaggccgcugaccugaaauccacacaagccgcuauugaucagaucaaugggaaacuuaaccggcugaucgagaagaccaaugaaaaguuucaucagauugagaaggaguucagcgaaguugaaggaagaauccaagaccucgagaaauacguggaggauacgaagauugaccuguggucuuauaacgccgaacugcucgucgcccuggagaaucagcacacaaucgaucuuaccgacuccgaaaugaacaaacuguucgagcgcacccggaagcagcucagagaaaacgcugaggauaugggcaaugggugcuuuaaaauuuaccauaagugugacaacgcgugcaucggcagcauucgcaauggaacauacgaccacgauguguaucgggacgaggcccugaacaauagauuccagaucaagggcguugaacuuaaaucuggguacaaggauuggauccuguggauuuccuuugcuaucagcugcuuccuccugugugugguccugcucggauuuauuaugugggccugccaaaaaggcaacauccgcuguaauauuugcaucuga

SEQ ID NO: 191674 - RNA, 1701 nt, Artificial Sequence
  derived and/or modified sequence opt5 from hemagglutinin__InfluenzaA__AFH00208
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagaacggcgauucuuaugccugcaagcggggcuccgucaagagcuuuuucucucgccucaauuggcugcacgaguccgaguacaaauauccugcgcuuaacgugacaaugcccaauaacgacaaguuugauaaacuguacaucuggggaguucaucacccuagcaccgacagagaacaaacaucucucuacauucgggccuccgggcgcgugaccgucagcacgaagagaucccagcagacagugaucccgaauauuggcucucggcccugggugcgcgggcugagcuccagaaucagcauuuauuggaccaucgucaaaccuggagacauccugcucauuaacucuacaggcaaccugaucgcuccccggggguacuucaagauucgcaccggaaaguccagcguuaugagaucugaugccccuaucggcaccuguagcuccgagugcauuacacccaauggcucuaucccgaacgacaaaccuuuucagaaugugaaccggaucacguauggggcuuguccccgcuacgugaagcaaaauacccuuaaacuggccacaggaaugagaaacgucccugaaaagcagacccggggcauuuucggggcgaucgccggauuuauugagaauggcugggaggggaugguggauggaugguauggcuucagacaccagaacagcgaaggcacagggcaggcugccgaccucaaauccacccaagcugccaucgaucagauuaauggaaagcugagccgccuuaucgagaaaacgaacgaaaaguuucaucagaucgagaaggaguucucugaaguugagggccggauucaagaccuggaaaaauacguggaggauacaaagaucgaccucugguccuauaaugccgaacugcuggucgcucucgagaaccagcacaccauugaucugaccgacagcgaaaugaauaaacuuuucgagaagacaagaaaacagcugcgcgagaacgcggaagauauggggaauggaugcuuuaagaucuaccauaagugugacaacgccugcauuggcucuauccggaacgggaccuacgaccacgauguguauagagacgaggcucucaauaaccgcuuccagauuaaaggcguugaacugaaguccggauacaaagauuggauccuuuggaucagcuuugccauuuccugcuuccugcucugugugguccugcugggcuuuaucaugugggccugccaaaaggggaauauucgguguaacaucugcauuuga

SEQ ID NO: 191675 - RNA, 1701 nt, Artificial Sequence
  derived and/or modified sequence opt5 from hemagglutinin__InfluenzaA__AFH00219
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagaucccaacugcgacggcuuucagaauaaggagugggaucucuucgucgaacgcagcaaagccuauuccaacuguuacccuuaugacgugcccgauuacgcuucucugagaagccuuguugccuccagcgggacgcuggaguuuaccaaugaagacuucaacuggacaggaguggcucaggauggcggcucuuaugccugcaagcggggguccgucaauagcuuuuucucucgccucaacuggcugcauaaacuugaguacaaguauccugcgcugaaugugaccaugcccaacaauggaaaguuugacaaacucuacauuuggggcguucaccauccuuccacagauagcgaccaaaccucucuguacgugagagccuccgggcgggucacggugagcacaaagcgcucccagcagaccgugacaccgaacaucggaucuagacccuggguccggggccugagcucccgcauuagcaucuauuggaccauuguuaaaccuggggacauccuccugauuaacucuaccggaaaucuuaucgcucccagaggcuacuucaagauccggaacggcaaguccagcauuaugcgcucugaugccccuaucgggacauguagcuccgagugcauuacgcccaauggaucuaucccgaacgacaaaccuuuucagaaugugaacagaauuaccuauggcgcuuguccccgguacgugaagcaaaauacacugaaacucgccaccgggaugcgcaacgucccugaaaagcagacaagaggaaucuucggcgcgaucgccggguuuauugagaauggaugggaaggcaugguggauggcugguauggguuccggcaccagaacagcgagggaaccggccaggcugccgaccugaaauccacgcaagcugccaucgaucagauuaaugggaaacuuaacagacugaucgacaagacaaaugagaaguuucaccagauugaaaaggaguucagcgaaguugagggacgcauccaagaucucgaaaaauacguggaggacaccaagaucgaucuguggucuuauaacgccgagcugcucgucgcucuggaaaaucagcauaccauugaccuuacagauuccgagaugaacaaacuguucgaaaagacccggaaacagcucagagagaacgcggaagacaugggcaaugggugcuuuaagaucuaccacaagugugacaacgccugcauuggcagcauccgcaauggaacauacgaucaugacguguaucgggaugaggcucugaacaauagauuccagauuaaaggcguugagcuuaagucuggguacaaagacuggauccuguggauuuccuuugccaucagcugcuuccuccugugugugguccugcucggauuuaucaugugggccugccaaaagggcaacauucgcuguaauaucugcauuuga

SEQ ID NO: 191676 - RNA, 1701 nt, Artificial Sequence
  derived and/or modified sequence opt5 from hemagglutinin__InfluenzaA__AFH00230
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaagagcuuuuucucucgccucaacuggcugcacaaacuugaguacaaauauccugcgcugaaugugacaaugcccaacaaugggaaguuugacaaacucuacaucuggggaguucaucacccuuccaccaacagcgaucaaacaucucuguacgugagagccuccggccgggucaccgugagcacgaagcgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaaaauccggaauggcaagucuuccauuaugcgcagcgacgccccuaucggcaacuguucuagcgagugcauuacccccaauggguccaucccgaacgauaaaccuuuccagaaugugaacagaaucaccuauggagcuuguccccgguacgugaagcaaaauacacugaaacucgccacgggcaugcgcaacgucccugaaaagcagaccagagggauuuuuggagcgaucgccggcuucauugagaaugggugggaaggaaugguggacggcugguauggcuuucggcaccagaacucugaggggacaggacaggcugccgaucugaaaagcacccaagcugccaucgaccagauuaauggcaaacuuaacagacugaucgagaagacaaaugaaaaguuccaucagaucgagaaggaguucuccgaaguugaagggcgcauucaagaucucgagaaauacguggaggacaccaagaucgaucuguggagcuauaacgccggacugcucgucgcucuggaaaaucagcacacgauugaccuuacagauucugagaugaacaaacuguuugaacggaccagaaagcagcuccgcgagaacgcggaagacaugggcaaugggugcuucaagaucuaccauaaaugugauaacgccugcauuggcuccauccggaauggaaccuacgaccacgacguguauagagaugaggcucugaacaaucgcuuucagauuaagggcguugagcuuaaaagcggguacaaggacuggauccuguggaucucuuucgccauuuccugcuuucuccugugugugguccugcucggauucaucaugugggccugccaaaaaggcaacauucgguguaauaucugcauuuga

SEQ ID NO: 191677 - RNA, 1701 nt, Artificial Sequence; identical to SEQ ID NO: 184048
  derived and/or modified sequence opt5 from hemagglutinin__InfluenzaA__AFH00241

SEQ ID NO: 191678 - RNA, 1701 nt, Artificial Sequence
  derived and/or modified sequence opt5 from hemagglutinin__InfluenzaA__AFH00252
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacgauuuucagaacaaggagugggaccucuucgucgaacgcagcaaagccuauuccaauuguuacccuuaugaugugcccgacuacgcuucucugagaagccuuguugccuccagcggcacgcuggaguuuauuaacgaagauuucaauuggaccgggguggcucagucuggagacuccuaugccugcaagcggggcagcgucaagucuuucuucucccgccucaacuggcugcacgagagcgaguacaaauauccugcgcuuaaugugacaaugcccaacaaugauaaguuugacaaacuguacaucuggggcguucaucacccuucuaccgacagagaacaaacaucccucuacauucgggccagcgggcgcgugaccgucuccacgaagagaucucagcagacagugaucccgaacauuggaagccggcccugggugcgcggccuguccagcagaaucucuauuuauuggaccaucgucaaaccuggggauauccugcucauuaauuccacaggaaaccugaucgcuccccggggcuacuucaagauucgcaccgggaaguccucuaucaugagaagcgacgccccuauuggaaccuguuccucugagugcaucacacccaacggcagcaucccgaaugauaaaccuuuucagaacguuaaucggauuacguauggcgcuuguccccgcuacgugaagcaaaacacccuuaaacuggccacagggaugagaaaugugccugaaaagcagacccggggaaucuucggcgcgauugccggguuuaucgagaacggaugggagggcauggucgacgggugguauggauucagacaccagaauagcgaaggcacaggccaggcugccgaucucaaaagcacccaagcugccauugaccagaucaacgggaagcugaaucgccuuaucgagaaaacgaacgaaaaguuucaucagauugagaaggaauuuucugagguggagggacggauccaagaucuggaaaaauacguugaggacacaaagauugaucucugguccuauaaugccgaacugcugguggcucucgagaaccagcacaccaucgaccugaccgauagcgaaaugaauaaacuuuucgagaagacaagaaaacagcugcgcgagaacgcggaagacaugggcaaugggugcuuuaagauuuaccauaagugugacaacgccugcaucggaucuauucggaacggcaccuacgaucacgacgucuauagagaugaggcucucaauaaccgcuuccagaucaaagggguggaacugaaguccggcuacaaagacuggauccuuuggauuagcuuugccaucuccugcuuccugcucuguguugugcugcugggauuuauuaugugggccugccaaaagggcaauauccgguguaacauuugcaucuga

SEQ ID NO: 191679 - RNA, 1701 nt, Artificial Sequence
  derived and/or modified sequence opt5 from hemagglutinin__InfluenzaA__AFH00263
augaagaccaucauugcccugagcuacauccuccaccugguguucgcucagaaacuucccggcaacgacaauuccacagccacgcugugccucgggcaucacgcggucccuaacggaacccugguuaagacaauuaccaaugaucaaaucgaggugacaaacgcuaccgaacuugugcagucuagcuccacaggcagaauuugugacucuccgcaucggauccuggaugggaaaaauugcacccucaucgacgcccugcugggagaucccaacugugacggcuuucagaauaaggagugggaucucuucgucgaacgcagcaaagccuauuccaacugcuacccuuaugacgugcccgauuacgcuucucugagaagccuuguugccuccagcgggacgcuggaguuuaccaaugaagacuucaacuggacaggaguggcucaggauggcggcucuuaugccuguaagcggggguccgucaauagcuuuuucucucgccucaacuggcugcacaaacuugaguacaaguauccugcgcugaaugugaccaugcccaacaauggaaaguuugacaaacucuacauuuggggcguucaucacccuuccacagauagcgugcaaaccucucuguacgucagagccuccgggaaggugacggugagcacaaaacggucccagcagaccgucacaccgaacaucggaucuaagcccuggguucgcggccugagcuccagaauuagcaucuauuggaccauugugaagccuggggacauccuccugauuaacucuaccggaaaucuuaucgcuccccggggcuacuucaaaauccgcaacggcaaguccagcauuaugagaucugacgccccuaucgggacaugcagcuccgaguguauuacgcccaauggaucuaucccgaacgauaaaccuuuucagaaugugaaccggauuaccuauggcgcuugcccccgcuacgucaagcaaaauacacugaaacucgccaccgggaugagaaacgugccugaaaagcagacacggggaaucuucggcgcgaucgccggguuuauugagaauggaugggaaggcaugguugacggcugguauggguuccgccaccagaacagcgagggaaccggccaggcugccgaucugaaauccacgcaagcugccaucgaccagauuaaugggaaacuuaacagacugaucgagaagacaaaugaaaaguuucaucagauugagaaggaguucagcgaaguggaaggacggauccaagaucucgagaaauacgucgaggacaccaagaucgaucuguggucuuauaacgccgaacugcucguggcucuggagaaucagcacaccauugaccuuacagauuccgaaaugaacaaacuguucgagaagaccagaaagcagcuccgcgaaaacgcggaggacaugggcaauggguguuuuaaaaucuaccauaagugcgauaacgccuguauuggcagcauccggaauggaacauacgaccacgacguuuauagagaugaggcucugaacaaucgcuuccagauuaaaggcguggaacuuaagucuggguacaaagacuggauccuguggauuuccuuugccaucagcugcuuccuccugugcgucgugcugcucggauuuaucaugugggccugucaaaagggcaacauucggugcaauaucuguauuuga

SEQ ID NO: 191680 - RNA, 1701 nt, Artificial Sequence
  derived and/or modified sequence opt5 from hemagglutinin__InfluenzaA__AFH00274
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagcggcauuuccaucuauuggaccauuguuaagccuggggacauccuccugaucaacagcacaggaaaccuuauugcuccccgcggcuacuuuaagaucagaaauggcaaaucuuccauuaugcggagcgaugccccuaucgggaacuguucuagcgagugcauuacccccaauggauccaucccgaacgacaagccuuuccagaaugugaaccgcaucaccuauggcgcuugucccagauacgugaaacaaaauacacugaagcucgccacggggaugcggaacgucccugaaaaacagacccgcggaauuuuuggcgcgaucgccggguucauugagaauggaugggaaggcaugguggauggcugguauggguuuagacaccagaacucugagggaacaggccaggcugccgaccuuaagagcacccaagcugccaucgaucagauuaaugggaaacugaaccggcugaucgagaagacaaaugaaaaguuccaucagaucgagaaagaguucuccgaaguugaaggacgcauucaagaccucgagaaguacguggaggauaccaaaaucgaccuguggagcuauaacgccggccugcucgucgcucuggaaaaucagcacacgauugaucuuacagacucugagaugaacaagcuguuugaaagaacccggaaacagcucagagagaacgcggaagauauggggaauggcugcuucaagaucuaccauaagugugacaacgccugcauuggauccauccgcaauggcaccuacgaccacgauguguaucgggacgaggcucugaacaauagauuucagauuaaagggguugagcuuaagagcggauacaaagauuggauccuguggaucucuuucgccauuuccugcuuucuccugugugugguccugcucggcuucaucaugugggccugccaaaaggggaacauucgcuguaauaucugcauuuga

SEQ ID NO: 191681 - RNA, 1701 nt, Artificial Sequence
  derived and/or modified sequence opt5 from hemagglutinin__InfluenzaA__AFH00285
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgggucuccgcaccggauccuggacgggaaaaauuguacccucaucgaugcccugcugggcgacccccauugcgauggguuucagaacaaggagugggaccucuucgucgaacgcagcaaagccuauuccaauuguuacccuuaugaugugcccgacuacgcuucucugagaagccuuguugccuccagcggaacgcuggaguuuauuaacgaagauuucaauuggaccggcguggcucaggacggcgggucuuaugccugcaagcggggauccgucaacagcuuuuucucucgccucaauuggcugcacaaacuugaguacaaguauccugcgcugaacgugacaaugcccaauaacggcaaguuugauaaacucuacaucuggggaguucaucacccuuccaccgacagcgaucaaacaucucuguacgugagagccuccggacgggucaccgugagcacgaagcgcucccagcagacagugaccccgaauauuggcucuagacccuggguccgggggcagagcucccgcaucagcauuuauuggacaaucguuaaaccuggagacauucugcucaucaacucuaccggcaaccugaucgcucccagaggcuacuucaagauucggaaugggaaguccagcaucaugcgcucugacgccccuauuggaaacuguagcuccgagugcaucacccccaauggcucuauuccgaacgauaaaccuuuucaaaaugugaacagaaucacauauggggcuuguccccgguacgugaagcagaauacgcuuaaacuggccaccggaaugcgcaacgucccugaaaagcagacaagaggcaucuucggggcgauugccggauuuaucgagaauggcugggaaggcaugguggacgggugguauggauuccggcaccagaacagcgagggcaccgggcaagcugccgaucucaaauccacacaggcugccauugaccagaucaauggaaagcugaacagacuuauugagaaaaccaaugaaaaguuucaucaaaucgagaaggaguucagcgaaguugaaggccgcauccaggaucuggagaaauacguggaggacacgaagauugaucucuggucuuauaacgccgaacugcuggucgcucucgagaaucagcacacaaucgaccugaccgauuccgaaaugaacaaacuuuucgagaagacccggaaacagcugagagaaaacgcggaggacauggggaauggcugcuuuaagauuuaccauaagugugauaacgccugcaucggaagcauucgcaauggcacauacgaccacgacguguaucgggaugaggcucucaacaauagauuccaaaucaaagggguugaacugaagucuggauacaaagacuggauucuuuggaucuccuuugccaucagcugcuuccugcucugugugguccugcugggcuuuauuaugugggccugccagaaggggaacauccgcuguaauauuugcaucuga

SEQ ID NO: 191682 - RNA, 1701 nt, Artificial Sequence
  derived and/or modified sequence opt5 from hemagglutinin__InfluenzaA__AFH00296
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaaucuguacgugcgggccuccgggcgcgucaccgugagcacgaagagaucccagcagacagugauuccgaacaucggaucucggcccuggguccgcggccucagcuccagaauuagcaucuauuggaccauuguuaagccuggggauauccugcugaucaacucuacaggaaaucucauugcuccccggggcuacuuuaaaauccgcaccggcaaguccagcauuaugagaucugacgccccuaucgggaccuguagcuccgagugcauuacacccaacggaucuaucccgaaugacaagccuuuccagaacgugaaucggaucacguauggcgcuuguccccgcuacgugaaacaaaacacccugaaacuugccacagggaugagaaaugucccugaaaagcagacccggggaauuuuuggcgcgaucgccggguucauugagaacggaugggagggcaugguggauggcugguauggguuuagacaccagaauagcgaaggaacaggccaggcugccgaccugaaguccacccaagcugccaucgaucagauuaacgggaaacucaaucgccugaucgagaagacgaacgaaaaauuccaucagaucgagaaggaguucagcgaaguugagggacggauucaagaccuugaaaaguacguggaggauacaaaaaucgaccuguggucuuauaaugccgaacuccuggucgcucuggagaaccagcacaccauugaucucaccgacuccgaaaugaauaagcuguuugagaaaacaagaaagcagcuucgcgagaacgcggaagauaugggcaacgggugcuucaaaaucuaccauaagugugacaaugccugcauuggcagcauccggaacggaaccuacgaucacgacguguauagagacgaggcucugaauaaccgcuuucagauuaagggcguugaacucaaaucuggguacaaggauuggauccuguggaucuccuucgccacaagcugcuuucuucugugugugguccuccugggauucauuaugugggccugccaaaaaggcaauauccgguguaacauuugcaucuga

SEQ ID NO: 191683 - RNA, 1701 nt, Artificial Sequence
  derived and/or modified sequence opt5 from hemagglutinin__InfluenzaA__AFH00307
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugaccccgaauauuggaucuagacccuggguccggggccagagcucccgcaucagcauuuauuggacaaucguuaaaccuggggacauucugcucaucaacucuaccggaaaccugaucgcucccagaggcuacuucaagauucggaauggcaaguccagcaucaugcgcucugaugccccuauugggaacuguagcuccgagugcaucacccccaauggaucuauuccgaacgacaaaccuuuucaaaaugugaacagaaucacauauggcgcuuguccccgguacgugaagcagaauacgcuuaaacuggccaccgggaugcgcaacgucccugaaaagcagacaagaggaaucuucggcgcgauugccggguuuaucgagaauggaugggaaggcaugguggauggcugguauggguuccggcaccagaacagcgagggaaccggccaagcugccgaccucaaauccacacaggcugccauugaucagaucaaugggaagcugaacagacuuauugagaaaaccaaugaaaaguuucaucaaaucgagaaggaguucagcgaaguugaaggacgcauccaggaccuggagaaauacguggaggauacgaagauugaccucuggucuuauaacgccgaacugcuggucgcucucgagaaucagcacacaaucgaucugaccgacuccgaaaugaacaaacuuuucgagaagacccggaaacagcugagagaaaacgcggaggauaugggcaaugggugcuuuaagauuuaccauaagugugacaacgccugcaucggcagcauucgcaauggaacauacgaccacgauguguaucgggacgaggcucucaacaauagauuccaaaucaaaggcguugaacugaagucuggguacaaagauuggauucuuuggaucuccuuugccaucagcugcuuccugcucugugugguccugcugggauuuauuaugugggccugccagaagggcaacauccgcuguaauauuugcaucuga

SEQ ID NO: 191684 - RNA, 1701 nt, Artificial Sequence; identical to SEQ ID NO: 191683
  derived and/or modified sequence opt5 from hemagglutinin__InfluenzaA__AFH00318

SEQ ID NO: 191685 - RNA, 1701 nt, Artificial Sequence
  derived and/or modified sequence opt5 from hemagglutinin__InfluenzaA__AFH00329
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucucaccaucggauccuggaugggaaaaauuguacccucaucgacgcccugcugggagauccgcacugcgacggcuuucagaacaaggagugggaucucuucgucgaacgcagcaaagccuauuccaauuguuaccccuaugacgugccugauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcauaaacuugaguacaaguaucccgcgcugaacgugacaaugccuaauaacgggaaauuugacaagcucuacaucuggggaguucaccaccccuccaccgauagcgaccaaacaucuauuuacgugagagccuccggccgggucaccgugagcacgaaacgcucccagcagacagugaucccuaauauugggucuagaccguggguccggggaaucagcucccgcauuagcaucuauuggaccaucguuaagcccggcgacauucugcugaucaacucuacagggaaccucauugcuccuagaggauacuucaagauccggaauggcaaauccagcauuaugcgcucugaugcccccaucggcaacuguaauagcgagugcaucaccccuaacggguccauucccaaugacaagccguuucagaacgugaauagaaucaccuauggagcuuguccucgguacgugaaacaaaacacacugaagcuggccacgggcaugcgcaauguccccgaaaaacagaccagagggauuuucggagcgaucgccggcuuuauugagaacgggugggaaggaaugguggauggcugguauggcuuccggcaucaaaauucugaggggacaggacaggcugccgaccuuaagagcacccaggcugccaucgaucagaucaacggcaaacucaauagacugauugagaagacaaacgaaaaguuucaccagaucgagaaagaguucuccgaaguugaagggcgcauucaagaccuugagaaguacguggaggauaccaaaaucgaccuguggagcuauaaugccgaacuccuggucgcucuggagaaccagcauacgauugaucucacagacucugaaaugaacaagcuguucgagcggaccagaaaacagcuucgcgaaaaugcggaggauaugggaaacggcugcuuuaagaucuaccacaagugugacaaugccugcauuggguccauccggaacggcaccuacgaccacgauguguauagagacgaggcucugaauaaccgcuuccagaucaaaggaguugaacucaagagcggcuacaaagauuggauucuguggaucucuuuugccacauccugcuuccuucugugugugguccuccugggguuuauuaugugggccugccaaaagggaaauauccgguguaacauuugcaucuga

SEQ ID NO: 191686 - RNA, 1701 nt, Artificial Sequence
  derived and/or modified sequence opt5 from hemagglutinin__InfluenzaA__AFH00340
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucagcucuacagggaaccuuauugcucccagaggauacuuuaagauccggaacggcaaauccagcauuaugcgcucugaugccccuaucggcaauuguagcuccgagugcauuacccccaacgggucuaucccgaaugacaagccuuuccagaacgugaauagaaucaccuauggagcuuguccccgguacgugaaacaaaacacacugaagcucgccacgggcaugcgcaauauuccugaaaaacagaccagagggaucuuuggagcgauugccggcuucaucgagaacgggugggaaggaauggucgauggcugguauggcuuucggcaccagaauagcgaggggacaggacaggcugccgaccugaaguccacccaagcugccauugaucagaucaacggcaaacuuaauagacugaucgagaagacaaacgaaaaguuccaucagauugagaaagaguucagcgaaguggaagggcgcauccaagaccucgagaaguacguugaggauaccaaaauugaccuguggucuuauaaugccggacugcucguggcucuggaaaaccagcacacgaucgaucuuacagacuccgagaugaauaagcuguuugaacggaccagaaaacagcuccgcgagaacgcggaagauaugggcaacgggugcuucaagauuuaccauaagugugacaaugccugcaucggcagcauucggaacggaaccuacgaccacgaugucuauagagacgaggcucugaauaaccgcuuucagaucaaaggcguggagcuuaagucuggguacaaagauuggauccuguggauuuccuucgccaucagcugcuuucuccuguguguugugcugcucggauucauuaugugggccugccaaaagggcaauauccgguguaacauuugcaucuga

SEQ ID NO: 191687 - RNA, 1701 nt, Artificial Sequence
  derived and/or modified sequence opt5 from hemagglutinin__InfluenzaA__AFH00351
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaagagcuuuuucucucgccucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccggcagagucacggugagcacaaagcggucccagcagaccgugaucccgaauauugggucucgccccugggucagaggaaucagcucccggauuagcaucuauuggacaauuguuaaaccuggcgacauccugcucaucaacucuaccgggaaucugauugcuccccgcggauacuucaagaucagaaacggcaaauccagcauuaugcggucugaugccccuaucggcaacuguaauagcgagugcauuacccccgacggguccaucccgaacgauaagccuuuucaaaaugugaaccgcaucacauauggagcuugucccagauacgugaaacagaauacgcuuaagcuggccaccggcaugcggaacgucccugaaaaacagacacgcgggauuuucggagcgaucgccggcuuuauugagaaugggugggaaggaaugguggacggcugguauggcuucagacaccagaacucugaggggaccggacaagcugccgaucucaagagcacacaggcugccaucgaccagauuaauggcaagcugaaccggcuuaucgagaaaaccaauaagaaauuucaucaaaucgaaaaggaguucuccgaaguugaggggcgcauucaggaucuggaaaaauacguggaggacacgaagaucgaucucuggagcuauaacgccgagcugcuggucgcucucgaaaaucagcacacaauugaccugaccgauucugagaugaacaaacuuuucgaaagaacccggaagcagcugagagagaaugcggaagacaugggaaacggcugcuuuaagaucuaccauaaaugugacaacgccugcauuggguccauccgcaauggcacauacgaucacgacguguaucgggaugaggcucucaacaauagauuccaaauuaagggaguugagcugaaaagcggcuacaaggacuggauccuuuggaucucuuuugccauuuccugcuuccugcucugugugguccugcugggguuuaucaugugggccugccagaagggaaacauucgcuguaauaucugcauuuga

SEQ ID NO: 191688 - RNA, 1701 nt, Artificial Sequence
  derived and/or modified sequence opt5 from hemagglutinin__InfluenzaA__AFH00362
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaagagcuuuuucucucgccucaacuggcugcacaaacuugaguacaaauauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucgacaauuguaacagcgagugcauuacccccaauggcuccaucccgaacgauaaaccuuuucaaaaugugaaccgcaucacauauggggcuugucccagauacgugaagcagaauacgcuuaaacuggccaccggaaugcggaacgucccugaaaagcagacacgcggcauuuucggggcgaucgccggauuuauugagaauggcugggaagggaugguggacggaugguauggcuucagacaccagaacucugagggcaccgggcaagcugccgaucucaaaagcacacaggcugccaucgaccagauuaauggaaagcugaaccggcuuaucgagaagaccaaugaaaaauuucaucaaaucgagaaggaguucuccgaaguugaaggccgcauucaggaucuggagaaauacguggaggacacgaagaucgaucucuggagcuauaacgccgaacugcuggucgcucucgagaaucagcacacaauugaccugaccgauucugaaaugaacaaacuuuucgagagaacccggaagcagcugagagaaaacgcggaggacauggggaauggaugcuuuaagaucuaccauaaaugugacaacgccugcauuggcuccauccgcaaugggacauacgaucacgacguguaucgggaugaggcucucaacaauagauuccaaauuaagggcguugaacugaaaagcggauacaaggacuggauccuuuggaucucuuuugccaccuccugcuuccugcucugugugguccugcugggcuuuauuaugugggccugccagaaagggaacauccgcuguaauauuugcaucuga

SEQ ID NO: 191689 - RNA, 1701 nt, Artificial Sequence
  derived and/or modified sequence opt5 from hemagglutinin__InfluenzaA__AFH00384
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuauugggaaccugaucgcuccccgcggauacuucaaaauuagaaacggcaaguccagcaucaugcggucugaugccccuauuggcaauuguaacagcgagugcaucacccccaauggguccaucccgaacgacaaaccuuuucaaaaugugaaccgcauuaccuauggagcuugucccagauacgugaagcagaauacacuuaaacuggccacgggcaugcggaacgucccugaaaagcagacccgcgggaucuucggagcgauugccggcuuuaucgagaaugggugggaaggaaugguggauggcugguauggcuucagacaccagaacucugaggggacaggacaagcugccgaccucaaaagcacccaggcugccauugaucagaucaauggcaagcugaaccggcuuaucgagaagacaaaugaaaaauuucaucaaauugagaaggaguucuccgaaguugaagggagaauccaggaccuggagaaauacguggaggauaccaagauugaccucuggagcuauaacgccggacugcuggucgcucucgaaaaucagcacacgaucgaucugacagacucugagaugaacaaacuuuucgaacgcacccggaagcagcugagagagaacgcggaagauaugggcaaugggugcuuuaagauuuaccauaaaugugacaacgccugcaucggcuccauucgcaauggaaccuacgaccacgauguguaucgggacgaggcucucaacaauagauuccaaaucaagggcguugagcugaaaagcggguacaaggauuggauccuuuggauuucuuuugccaucuccugcuuccugcucugugugguccugcugggauuuauuaugugggccugccagaaaggcaacauccgcuguaauauuugcaucuga

SEQ ID NO: 191690 - RNA, 1701 nt, Artificial Sequence
  derived and/or modified sequence opt5 from hemagglutinin__InfluenzaA__AFH00395
augaaggccaucauugcucugagcuacauccucugccugguguucgcccagaaacuucccggcaacgacaauuccaccgcgacacugugucucgggcaccaugcugucccuaacggaacgcugguuaagaccauuacaaaugaucaaaucgaggugaccaacgccacagaacuugugcagucuagcuccaccggcagaauuugcgacucuccgcaccggauccuggaugggaaaaauuguacacucaucgacgcccugcugggagauccccauugcgacggcuuucagaacaaggagugggaucucuucgucgaacgcagcaaggcuuauuccaauuguuacccuuaugacgugcccgauuacgccucucugagaagccuuguugcuuccagcgggacccuggaguuuacgaaggaaggauucaacuggaccggcguggcccaggacggcaagucuuaugcgugcaaacggggguccgucaauggauuuuucagccgccucaacuggcugcacaaacuugaguacaaauauccugcccugaaugugacaaugcccaacaaugauaaguuugacaaacucuacauuuggggcguucaucacccuucuaccgauuccgaccaaacaagccuguacgugcaggcuucugggagagucaccguguccacgaagcggagccagcagacagugaucccgaacauuggaucccgccccugggucagaggcaucucuagccggauuuccaucuauuggaccauuguuaagccuggggacauccugcucaucaaaagcacaggaaaucugauugcccccagaggcuacuucaagaucagaaacggcaaaucuuccauuaugcggagcgaugcuccuaucgggaacuguaauucugagugcauuacccccaacggaagcaucccgaaugacaagccuuuucaaaacgugaaucgcaucaccuauggcgccugucccagauacgugaaacagaacacacuuaagcuggcgacggggaugcggaaugucccugaaaaacagacccgcggaauuuucggcgccaucgcuggguuuauugagaacggaugggaaggcaugguggauggcugguauggguucagacaccaaaauuccgagggaacaggccaggccgcugaccucaagucuacccaggccgccaucgaucagauuaacgggaagcugaaucggcuuaucgagaaaacaaacgaaaaguuucaucaaaucgagaaagaguucagcgaaguugaaggacgcauucaggaccuggagaaguacguggaggauaccaaaaucgaccucugguccuauaaugcugaacugcuggucgcgcucgagaaccagcacacgauugaucugacagacagcgaaaugaauaaacuuuucgagcgcacccggaagcagcugagagaaaacgccgaggauaugggcaacgggugcuuuaagaucuaccauaagugugacaaugcuugcauuggcucuauccgcaacggaaccuacgaccacgauguguaucgggacgaggcccucaauaacagauuccaaauuaaaggcguugaacugaaguccggguacaaagauuggauccuuuggaucagcuuugccauuucuugcuuccugcucugugugguccugcugggauuuaucaugugggcuugccagaagggcaauauucgcuguaacaucugcauuuga

SEQ ID NO: 191691 - RNA, 1701 nt, Artificial Sequence
  derived and/or modified sequence opt5 from hemagglutinin__InfluenzaA__AFH00417
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaagagcuuuuucucucgccucaacuggcugcacaaacuugaguacaaauauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucgacaauuguaacagcgagugcauuacccccaauggcuccaucccgaacgauaaaccuuuucaaaaugugaaccgcaucacauauggggcuugucccagauacgugaagcagaauacgcuuaaacuggccaccggaaugcggaacgucccugaaaagcagacacgcggcauuuucggggcgaucgccggauuuauugagaauggcugggaagggaugguggacggaugguauggcuucagacaccagaacucugagggcaccgggcaagcugccgaucucaaaagcacacaggcugccaucgaccagauuaauggaaagcugaaccggcuuaucgagaagaccaaugaaaaauuucaucaaaucgagaaggaguucuccgaaguugaaggccgcauucaggaucuggagaaauacguggaggacacgaagaucgaucucuggagcuauaacgccgaacugcuggucgcucucgagaaucagcacacaauugaccugaccgauucugaaaugaacaaacuuuucgagagaacccggaagcagcugagagaaaacgcggaggacauggggaauggaugcuuuaagaucuaccauaaaugugacaacgccugcauuggcuccauccgcaaugggacauacgaucacgacguguaucgggaugaggcucucaacaauagauuccaaauuaagggcguugaacugaaaagcggauacaaggacuggauccuuuggaucucuuuugccauuuccugcuuccugcucugugugguccugcugggcuuuaucaugugggccugccagaaagggaacauucgcuguaauaucugcauuuga

SEQ ID NO: 191692 - RNA, 1701 nt, Artificial Sequence; identical to SEQ ID NO: 184012
  derived and/or modified sequence opt5 from hemagglutinin__InfluenzaA__AFH00428

SEQ ID NO: 191693 - RNA, 1701 nt, Artificial Sequence
  derived and/or modified sequence opt5 from hemagglutinin__InfluenzaA__AFH00439
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaguuagcucccggaucagcauuuauuggaccaucgugaagccuggcgacauucugcucaucaauucuaccgggaaccugaucgcuccccgcggauacuucaagauuagauccggcaaaagcucuaucaugcggagcgaugccccuauuggcaacuguaauuccgagugcaucacacccaacgggucuauuccgaaugacaagccuuuucaaaacgugaaucgcaucacguauggagcuugucccagauacgucaaacagaacacccuuaagcuggccacaggcaugcggaaugugccugaaaaacagacccgcgggaucuucggagcgauugccggcuuuaucgagaacgggugggaaggaaugguugauggcugguauggcuucagacaccagaauagcgaggggacaggacaagcugccgaccucaaguccacccaggcugccauuaaccagaucaauggcaaacugaaccggcuuauugagaagacgaaugaaaaguuucaucaaaucgagaaagaguucagcgaaguggaagggagaauccaggaucuggagaaguacgucgaggacacaaaaauugaucucuggucuuauaacgccgaacugcugguggcucucgagaaucagcacaccaucgaccugaccgauuccgaaaugagcaaacuuuucgagcgcacacggaagcagcugagagaaaacgcggaggacaugggaaacggcugcuuuaagauuuaccauaagugugauaaugccugcaucgggucuauucgcaacggcaccuacgaccacgacguuuaucgggaugaggcucucaauaacagauuccaaaucaaaggaguggaacugaaguccggcuacaaagacuggauucuuuggaucagcuuugccaucuccugcuuccugcucugugucgugcugcugggguuuauuaugugggccugccagaagggaaauauccgcuguaacauuugcaucuga

SEQ ID NO: 191694 - RNA, 1701 nt, Artificial Sequence
  derived and/or modified sequence opt5 from hemagglutinin__InfluenzaA__AFH00450
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacgggccgcaccggaucaucgauggaaagaauuguacccugauugacgcccuccugggcgauccccauugcgacggguuucagaacaaggagugggaucuguucgucgaacgcucuaaagccuauagcaauuguuacccuuaugacgugcccgauuacgcuucccucagaucucugguugccagcuccggaacgcuugaguuuaccaacgagagcuucaauuggacaggcguggcucagaacggcaccucuuaugccugcaagcggggguccgucaagagcuuuuucucucgccugaauuggcuccacaaacuggaauacaaguauccugcgcuuaacgugacaaugcccaauaacgacaaauuugauaagcuguacaucuggggaguucaucacccuuccaccgacagcgaucaaacgucucucuacgugcaguccagcggcagagucacaguguccaccaaacggucucagcagacagugauuccgaauaucgggagccgccccugggucagaggaguuuccagccggauuucuaucuauuggaccauugugaagccuggcgacauccugcugaucaacuccaccgggaaccucauugcuccccgcggauacuucaagaucagaagcggcaaaucuagcauuaugcgguccgacgccccuaucgauaauuguaacucugagugcauuacacccaauggcagcaucccgaacgacaagccuuuucaaaaugugaaccgcaucacguauggggccugucccagauacgucaaacagaauacccugaaacuugcuacaggaaugcggaacgugccugaaaaacagacccgcggcauuuucggggccaucgcgggauuuauugagaauggcugggaagggaugaucgauggaugguauggcuucagacaccagaacuccgagggcacagggcaagccgcugaccucaagagcacccaggccgcuauuaaucagaucaacggaaaacugaaucggcugaucgagaagacgaacgaaaaguuucaucaaauugagaaagaguucucugaaguugaaggcagaauccaggaucuugagaaguacguggaggacacaaaaauugaucugugguccuauaaugccgaacuccuggucgcccuggagaaccagcacaccaucgaccucaccgauagcgaaaugaacaagcuguucgagcgcacacggaaacagcuuagagaaaaugcugaggacauggggaacggaugcuuuaagauuuaccauaagugugauaaugcgugcaucggcucuauucgcaacgggaccuacgaccacgacguguaucgggaugaggcccugaauaacagauuccaaaucaaaggcguugaacucaaguccggauacaaagacuggauccuguggauuagcuuugcuaucuccugcuuccuucugugugugguccuccugggcuuuauuaugugggccugccagaaggggaauauccgcuguaacauuugcaucuga

SEQ ID NO: 191695 - RNA, 1701 nt, Artificial Sequence
  derived and/or modified sequence opt5 from hemagglutinin__InfluenzaA__AFH00461
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuauuaacgaaaauuucaacuggaccggaguggcucaggacggcaagagcuaugccugcaagcggggcucugucaauuccuuuuucagccgccucaacuggcugcacaaacuugauuacaaguaucccgcgcugaaugugacaaugccuaacaaugggaaauuugacaagcucuacaucuggggaguucaucacccgucuaccgauuccgaccaaauuagccuguacgugagaucuuccggccgggucacagugagcaccaaacgcucccagcagacggugauccccgacauuggguauagaccuuggguccggggacugucuagccgcaucuccauuuacuggacaaucguuaagcccggcgauauccuccugauuaacagcaccgggaaccuuaucgccccuagaggauauuucaagcugcggaauggcaaaucuuccauuaugcgcagcgacgcucccaucggcaacuguucuagcgggugcauuacaccgaauggauccaucccuaacgauaagcccuuucagaaugugaacagaaucaccuacggcgccuguccucgguaugugaaacaaaauacccucaagcuggcuacagggaugcgcaacguccccgagaaacagacgagaggaauuuucggcgccaucgcgggguuuauugagaauggaugggaaggcaugguggacggcugguacggguuccggcaccagaacucugagggaaccggccaggccgcugaucuuaagagcacacaagccgcuaucgaccagauuaaugggaaacugaacagacucguugaaaagaccaaugagaaguuucaucagaucgagaaagaguucuccgaaguggaaggacgcauccaagaucuggagaaguaugucgaagacacaaaaauugaucuguggagcuacaacgccgagcuccugguggcccuugagaaucagcacaccaucgaccugacggauucugaaaugaacaagcuguucgagcggacaagaaaacagcugcgcgaaaacgcugaggacaugggcaaugggugcuuuaagauuuaccauaagugugacaacgcgugcaucggcuccauucggaauggaaccuaugaucacgacguuuacagagaugaagcccuuaacaaucgcuuccagaucaaaggcguggagcucaagagcggguauaaagacuggauucucuggaucucuuuugcuaucuccugcuuccugcugugugucgugcuccugggauuuauuaugugggccugccaaaagggcaacauccgguguaauauuugcaucuga

SEQ ID NO: 191696 - RNA, 1701 nt, Artificial Sequence
  derived and/or modified sequence opt5 from hemagglutinin__InfluenzaA__AFH00472
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugucugauuacgcuagccugagaucccuuguugccagcucugggacgcuggaguuuaacaaugaauccuucaacuggaccggaguggcucagaauggcacaagcuaugccugcaagcggcgcucugucaaguccuuuuucagcagacucaacuggcugcacaaacuugaguacaaguaucccgcgcugaaugugaccaugccuaacaaugacaaauuugauaagcucuacauuuggggcguucaucaccccucuacagacuccgaucaaaccagccuguacgugcaggccuccgggcgggucacggugucuacaaaacgcagccagcagaccgugaucccuaacauuggauccagaccguggguccggggcguuagcucucgcaucuccauuuauuggacaaucgugaagcccggggacauucugcucaucaacagcaccggaaaucugaucgcuccuagaggcuacuucaagauucggucugggaaaagcuccaucaugcgcucugacgcccccauuggaaacuguaauagcgagugcaucaccccuaacggcuccauucccaaugauaagccguuucaaaacgugaauagaaucacauauggcgcuuguccucgguacgucaaacagaacacgcuuaagcuggccaccgggaugcgcaaugugcccgaaaaacagacaagaggaaucuucggcgcgauugccggguuuaucgagaacggaugggaaggcaugguugacgggugguauggauuccggcaccagaauagcgagggcaccggccaagcugccgaucucaagucuacacaggcugccauuaaccagaucaaugggaaacugaacagacuuauugagaagaccaaugaaaaguuucaucaaaucgagaaagaguucuccgaaguggaaggacgcauccaggaccuggagaaguacgucgaggauacgaaaauugaccucuggagcuauaacgccgaacugcugguggcucucgagaaccagcacacaaucgaucugaccgacucugaaaugaauaagcuguucgagcggaccagaaaacagcugcgcgaaaacgcggaggauaugggcaaugggugcuuuaagauuuaccauaagugugacaacgccugcaucggauccauucggaauggcacauacgaucacgacguuuauagagacgaggcucucaacaaucgcuuccaaaucaaagggguggaacuuaagagcggcuacaaagauuggauucuuuggaucuccuuugccaucucuugcuuccugcucugugucgugcugcugggauuuauuaugugggccugccagaagggcaacauccgguguaauauuugcaucuga

SEQ ID NO: 191697 - RNA, 1701 nt, Artificial Sequence
  derived and/or modified sequence opt5 from hemagglutinin__InfluenzaA__AFH00483
augaagaccaucauugcccugagcuacauccucugcaugguguucgcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcaaaauuugcgacucuccgcacagaauccuugaugggaagaauuguacccugaucgacgcccuccugggagauccccauugcgacggcuuucagaacaaagagugggaucuguucgucgaacggagcaaggccuauuccaauuguuacccuuaugacgugcccgauuacgcuucucuccgcagccugguugccuccagcgggacgcuugaguuuaacaaugaaucuuucaacuggaccggaguggcucagaauggcacauccuaugccugcaagagaggcagcgucaaaucuuucuucucccggcugaacuggcuccacaagcuggaguacaaauauccugcgcuuaaugugaccaugcccaacaaugacaaguuugauaaacuguacauuuggggaguucaucacccuagcacagacucugaucaaaccucccucuacgugcaggccagcgggcgcgucacgguguccacaaagagaucucagcagaccgugaucccgaacauuggcagccggcccuggguccgcgggguuuccagcagaaucucuauuuauuggacaaucgugaagccuggagacauucugcugaucaacuccaccggcaaucucaucgcuccccggggguacuucaaaauucgcagcggaaagucuagcaucaugagauccgacgccccuauuggcaacuguaauucugagugcaucacccccaacggcagcauuccgaaugauaaaccuuuucaaaacgugaaucggaucacauauggggcuuguccccgcuacgucaagcagaacacgcugaaacuugccaccggaaugagaaaugugccugaaaagcagacacggggcaucuucggggcgauugccggauuuaucgagaacggcugggaagggaugguugacggaugguauggcuuccgccaccaaaauuccgagggcaccgggcaggcugccgaucugaaaagcacacaggcugccauuaaccagaucaauggaaagcucaacagacugauugagaagaccaaugaaaaauuucaucaaaucgagaaggaauuuucugagguggaaggccggauccaggaccuugagaaauacgucgaggauacgaagauugaccugugguccuauaacgccgaacuccugguggcucuggagaaccagcacacaaucgaucucaccgacagcgaaaugaauaaacuguucgagagaacccgcaagcagcuucgggaaaacgcggaggauauggggaauggaugcuuuaagauuuaccauaaaugugacaacgccugcaucggcucuauuagaaaugggacauacgaucacgacguuuaucgcgacgaggcucugaacaaucgguuccaaaucaagggcguggaacucaaauccggauacaaggauuggauucuguggaucagcuuugccaucuccugcuuccuucugugugucgugcuccugggcuuuauuaugugggccugccagaaagggaacaucagauguaauauuugcaucuga

SEQ ID NO: 191698 - RNA, 1701 nt, Artificial Sequence
  derived and/or modified sequence opt5 from hemagglutinin__InfluenzaA__AFH00494
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuauuaacgaaaauuucaacuggaccggaguggcucaggacggcaagagcuaugccugcaagcggggcucugucaauuccuuuuucagccgccucaacuggcugcacaaacuugaguacaaguaucccgcgcugaaugugacaaugccuaacaaugggaaauuugauaagcucuacaucuggggaguucaucacccgucuaccgacuccgaucaaacaagccuguacgugagagccucuggccgggucaccguguccacgaaacgcagccagcagacagugauucccgacaucggguauagaccuuggguccggggacaguccucucgcauuggcaucuacuggaccauuguuaagcccggggacauccugcucaucaacagcacaggaaaccugauugcuccuagaggcuauuucaagauccggaauggcaaauccagcauuaugcgcucugaugcccccaucgggaacuguuccagcgagugcauuaccccgaauggaucuaucccuaacgacaagcccuuucaaaaugugaacagaaucaccuacggcgcuuguccucgguaugugaaacagaauacacuuaagcuggccacggggaugcgcaacguccccgaaaaacagaccagaggaauuuucggcgcgaucgccggguuuauugagaauggaugggaaggcaugguggauggcugguacggguuccggcaccagaacagcgagggaacaggccaagcugccgaccucaaguccacccaggcugccaucgaucagauuaaugggaaacugaacagacuuguugagaagacaaaugaaaaguuucaucaaaucgagaaagaguucucugaaguggaaggacgcauccaggaccuggagaaguaugucgaggauaccaaaauugaccucuggagcuacaacgccgaacugcugguggcucucgagaaucagcacacgaucgaucugacagacuccgaaaugaacaaacuuuucgagcggaccagaaagcagcugcgcgaaaacgcggaggauaugggcaaugggugcuuuaagauuuaccauaagugugacaacgccugcaucggcagcauucggaauggaaccuauaaccacgacguuuacagagaugaggcucucaauaaccgcuuccaaaucaaaggcguggaacugaagucuggguauaaagacuggauucuuuggaucuccuuugccaucagcugcuuccugcucugugucgugcugcugggauuuauuaugugggccugccagaagggcaauauccgguguaacauuugcaucuga

SEQ ID NO: 191699 - RNA, 1701 nt, Artificial Sequence
  derived and/or modified sequence opt5 from hemagglutinin__InfluenzaA__AFH00505
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaaucucucuguacgugcaggccuccggcagagucacggugagcacaaaacggucccagcagaccgugauuccgaacaucgggucucgccccugggucagaggaguuagcuccauuaucagcauuuauuggacaaucgugaagccuggcgacauccugcucauuaauucuaccgggaaccugaucgcuccccggggauacuucaagauucgcuccggcaaaagcucuaucaugagaagcgaugccccuauugacaacuguaauuccgagugcaucacccccaacggcucuaucccgaaugauaagccuuuucaaaacgugaaucggauuacauauggggcuuguccccgcuacgucaaacagaacacgcuuaagcuggccaccggaaugagaaaugugccugaaaaacagacacggggcaucuucggggcgauugccggauuuaucgagaacggcugggaagggaugguugacggaugguauggcuuccgccaccagaauagcgagggcaccgggcaagcugccgaucucaaguccacacaggcugccauuaaccagaucaauggaaaacugaacagacuuaucgagaagaccaaugaaaaguuucaucaaauugagaaagaguucagcgaaguggaaggccggauccaggaccuggagaaguacgucgaggauacgaaaauugaccucuggucuuauaacgccgaacugcugguggcucucgagaaucagcacacaaucgaucugaccgacuccgaaaugaacaaacuuuucgagagaacccgcaagcagcugcgggaaaacgcggaggauauggggaauggaugcuuuaagauuuaccauaagugugacaacgccugcaucggcagcauuagaaaugggacauacgaccacgauguuuaucgcgacgaggcucucaacaaucgguuccaaaucaaaggcguggaacugaagucuggauacaaagauuggauccuuuggauuuccuuugccaucagcugcuuccugcucugugucgugcugcugggcuuuauuaugugggccugccagaaggggaacaucagauguaauauuugcaucuga

SEQ ID NO: 191700 - RNA, 1701 nt, Artificial Sequence
  derived and/or modified sequence opt5 from hemagglutinin__InfluenzaA__AFH00516
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggacaggcguggcucaagacggcaagucuuaugccugcaagcggggguccgucaacagcuuuuucucucgccugaauuggcuccacaaacuggaguacaaguauccugcgcuuaacgugaccaugcccaauaacgauaaauuugacaagcuguacauuuggggaguucaucacccuuccacagauagcgaccagaccucucucuacgugcaggccuccggcagagucacggugagcacaaaacggucccagcaaaccgugaucccgaauauugggucucgccccugggucagaggaaucagcucccggauuagcaucuauuggacaauuguuaagccuggcgacauccugcugaucaagucuaccgggaaccucauugcuccccgcggauacuucaaaaucagaaacggcaaguccagcauuaugcggucugaugccccuaucgacaauuguaacagcgagugcauuacccccaauggcuccaucccgaacgauaaaccuuuucagaaugugaaccgcaucacauauggggcuugucccagauacgugaagcagaauacgcugaaacuugccaccggaaugcggaacgucccugaaaagcagacacgcggcauuuucggggcgaucgccggauuuauugagaauggcugggaagggaugguggacggaugguauggcuucagacaccaaaacucugagggcaccgggcaggcugccgaucugaaaagcacacaggcugccaucgaccaaauuaauggaaagcucaaccggcugaucgagaagaccaaugaaaaauuucaucagaucgagaaggaguucuccgaaguugaaggccgcauucaggaucuugagaaauacguggaggacacgaagaucgaucuguggagcuauaacgccgaacuccuggucgcucuggagaaucagcacacaauugaccucaccgauucugaaaugaacaaacuguucgagagaacccggaagcaacuuagagaaaacgcggaggacauggggaauggaugcuuuaagaucuaccauaaaugugacaacgccugcauuggcuccauccgcaaugggacauacgaucacgacguguaucgggaugaggcucugaacaauagauuccagauuaagggcguugaacucaaaagcggauacaaggacuggauccuguggaucucuuuugccauuuccugcuuccuucugugugugguccuccugggcuuuaucaugugggccugccagaaagggaacauucgcuguaauaucugcauuuga

SEQ ID NO: 191701 - RNA, 1701 nt, Artificial Sequence
  derived and/or modified sequence opt5 from hemagglutinin__InfluenzaA__AFH00527
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggcgcagcaucaagucuuucuucuccagacugaacuggcuccaccaacugaaguacaaauauccugcgcuuaaugucaccaugcccaacaaugacaaguuugauaaacuguacauuuggggcgugcaucacccuagcacagacucugaucagaccucccucuacgcccaggcuagcgggcggguuacgguguccacaaagcgcucucagcaaaccgucaucccgaacauuggaagcagacccugggugcggggcguguccagccgcaucucuauucacuggacaaucgucaaaccuggggacauccugcugauuaacuccaccggaaaucucaucgcccccagaggcuauuucaagauucggagcgggaagucuagcaucaugcgcuccgacgcuccuauuggaaaauguaacucugagugcaucacccccaauggcagcaucccgaacgauaagccuuuucagaauguuaacagaauuacauacggcgccuguccccgguaugugaaacagaauacgcugaagcuggcgaccgggaugcgcaacgugccugaaaaacagacaagaggaaucuucggcgccauugcuggguuuaucgagaauggaugggaaggcauggucgacgggugguacggauuccggcaucaaaacuccgagggcaccggccaggccgcugaucuuaagagcacacaggccgccauuaaucaaaucaacgggaaacucaauagacugaucgagaagaccaacgaaaaguuucaccagauugagaaagaauuuucugagguggaaggacgcauccaggaccuugagaaguauguugaggauacgaaaauugaccugugguccuacaaugcugaacuccugguggcgcuggagaaccagcauacaaucgaucucaccgacagcgaaaugaacaagcuguucgagcggaccagaaaacaacuucgcgaaaaugccgaggauaugggcaacgggugcuuuaagauuuaucacaagugugacaaugcuugcaucggaucuauucggaacggcacauacgaucacgacgucuacagagacgaggcccugaauaaccgcuuccagaucaaagggguggaacucaaguccggcuauaaagauuggauccuguggauuagcuuugccaucuccugcuuccuucuguguguugugcuccugggauuuauuaugugggcuugccagaagggcaauauccgguguaacauuugcaucuga

SEQ ID NO: 191702 - RNA, 1701 nt, Artificial Sequence
  derived and/or modified sequence opt5 from hemagglutinin__InfluenzaA__AFH00538
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagagaucuagcacaggccggaucugcgacuccccgcaccgcauccuugauggggagaauuguacccugauugacgcccuccugggagauccccauugcgacggcuuucagaacaaagaaugggaucuguucgucgagagaucuaaggccuauagcaauuguuacccuuaugacgugcccgauuacgcuucccuccggucucugguugccagcuccgggacgcuugaauuuaacaaugagagcuucaacuggaccggaguggcucagaauggcacaucuuaugccugcaaacgcagauccaucaagagcuuuuucucucggcugaacuggcuccaccaacugaaguacaaauauccugcgcuuaaugucaccaugcccaacaaugacaaguuugauaaacuguacauuuggggcgugcaucacccuuccacagacagcgaucagaccucucucuacgcccaggcuuccgggcgcguuacggugagcacaaagagaucccagcaaaccgucaucccgaacauuggaucucggcccugggugcgcggcgugagcuccagaaucagcauuuauuggacaaucgucaaaccuggggacauccugcugauuaacucuaccggaaaucucaucgcuccccggggcuacuucaagauucgcuccggaaagagcucuaucaugagaagcgacgccccuauugggaaauguaacuccgagugcaucacccccaauggcucuaucccgaacgauaagccuuuucagaauguuaaccggauuacauauggcgccuguccccgcuacgugaaacagaauacgcugaaacuugcgaccgggaugagaaacgugccugaaaagcagacacggggaaucuucggcgccauugcuggguuuaucgagaauggaugggaaggcauggucgacgggugguauggauucagacaccaaaacagcgagggcaccggccaggccgcugaucugaaguccacacaggccgccauuaaucaaaucaacgggaaacucaaucgccugaucgagaagaccaacgaaaaguuucaucagauugagaaagaguucagcgaaguggaaggacggauccaggaccuugagaaguacguugaggauacgaaaauugaccuguggucuuauaaugcugaacuccugguggcgcuggagaaccagcacacaaucgaucucaccgacuccgaaaugaacaagcuguucgagagaacccgcaaacaacuucgggaaaaugccgaggauaugggcaacgggugcuuuaagauuuaccauaagugugacaaugcuugcaucggaagcauuagaaacggcacauacgaucacgacgucuaucgcgacgaggcccugaauaaccgguuccagaucaaagggguggaacucaagucuggcuacaaagauuggauccuguggauuuccuuugccaucagcugcuuccuucuguguguugugcuccugggauuuauuaugugggcuugccagaagggcaauaucagauguaacauuugcaucuga

SEQ ID NO: 191703 - RNA, 1701 nt, Artificial Sequence
  derived and/or modified sequence opt5 from hemagglutinin__InfluenzaA__AFH00549
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuccggggcggguuacgguguccacacgcagaucucagcaaaccgucauucccaacaucggaagccggccuugggugcgcggcguguccagcauuaucucuauuuacuggacaaucgucaagcccggggacauccugcucauuaacuccaccggaaaucugaucgccccuagaggcuauuucaaaauucggagcgggaagucuagcaucaugcgcuccgacgcucccauuucuaaguguaacagcgagugcaucaccccgaauggauccaucccuaacgauaaacccuuucagaauguuaacagaauuacauacggcgccuguccucgguaugugaagcagaauacgcuuaaacuggcgaccggcaugcgcaacgugcccgaaaagcagacaagagggaucuucggagccauugcuggcuuuaucgagaaugggugggaaggaauggucgacggcugguacggguuccggcaccaaaacagcgagggaaccggccaggccgcugaucucaaaucuacacaggccgccauuaaucaaaucaacggcaagcugaauagacuuaucgagaaaaccaacgaaaaguuucaucagauugagaaggaguucuccgaaguggaagggcgcauccaggaccuggagaaauauguugaggauacgaagauugaccucuggagcuacaaugcugaacugcugguggcgcucgagaaccagcacacaaucgaucugaccgacucugaaaugaacaaacuuuucgagcggaccagaaagcaacugcgcgaaaaugccgaggauaugggaaacggcugcuuuaaaauuuaucauaagugugacaaugcuugcaucggguccauucggaacggaacauacgaucacgacgucuacagagacgaggcccucaauaaccgcuuccagaucaagggcguggaacugaaaagcggguauaaggauuggauccuuuggauuuccuuugccaucucuugcuuccugcucuguguugugcugcugggcuuuauuaugugggcuugccagaaaggaaauauccgguguaacauuugcaucuga

SEQ ID NO: 191704 - RNA, 1701 nt, Artificial Sequence
  derived and/or modified sequence opt5 from hemagglutinin__InfluenzaA__AFH00560
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacaucccgcaucagauccuggauggcgagaauuguacccucauugacgcccugcugggggauccccacugcgacggauuucagaacaaagaaugggaucucuucguggagcggucuacggccuauagcaauuguuacccuuaugacguucccgauuacgcuucccugcgcucucuuguggccagcuccggcacccuggaauuuaacaaugagagcuucaacuggacaggggucgcucagaauggaaccucuuccgccugcaagagacggagcaucaaauccuuuuucucucgccucaacuggcugcaucaacuuaaguauaaguacccugcgcugaaugugacaaugcccaacaaugagaaauuugacaagcucuauauuuggggcguucaccacccuagcaccgauucugaccagaucucccuguacgcccaggcuccgggcagagugacggucagcacaaaacggucccagcaaaccgugauucccaacaucgggucucgcccuugggugagaggagucagcucccggauuagcaucuacuggacaaucguuaagcccggcgauauucugcucaucaacucuaccgggaaucugauugccccucgcggauauuucaaaaucagauccggcaagagcucuauuaugcggagcgacgcucccaucgggaaguguaacuccgaaugcaucaccccgaauggaucuauuccuaacgacaaacccuuucagaaugugaaccgcaucacauacggcgccuguccuagauaugugaagcagaauacgcuuaaacuggcgaccggcaugcggaacguccccgagaagcagacacgcgggauuuucggagccaucgcuggcuuuauugaaaaugggugggagggaaugguggauggcugguacggguucagacaucaaaacagcgagggaaccggccaggccgcugaccucaaauccacacaggccgccaucaaucaaaucaacggcaagcugaaucggcuuauugagaaaaccaacgaaaaguuucaccagaucgaaaaggaguucagcgaagcugaggggcgcauucaggaucuggagaaauauguugaagacacgaagaucgaucucuggucuuacaaugcggagcugcugguggcccucgaaaaccagcauacaauugaccugaccgauuccgagaugaacaaacuuuucgaaagaacccggaagcaacugagagagaaugcugaggacaugggaaacggcugcuuuaaaaucuaucacaagugugauaaugccugcauugggagcauccgcaacggaacauacgaccacgaugucuaccgggacgaagcccucaauaacagauuccagaucaagggcguggagcugaaaucuggguauaaggacuggauucuuuggaucuccuuugcuauuagcugcuuccugcucuguaucguucugcugggcuuuauuaugugggccugccagaaaggaaauauccgcuguaacaucugcauuuga

SEQ ID NO: 191705 - RNA, 1701 nt, Artificial Sequence
  derived and/or modified sequence opt5 from hemagglutinin__InfluenzaA__AFH00571
augaagaccaucauugcccugagcuacauccucugccugguguucgcucagaaacuucccgucaacgacaauuccacagccacgcugugucucggccaccaugcgguuccuaacgggacccuggugaagacaauuaccaaugauaacaucgaggugacaaaugcuaccgaacuuguccaaucuagcuccacaggaagaauuugcgacucuccgcaccagauccuggauggcgagaacuguacccucaucgacgcccugcugggggauccccauugcgacggauuucagaauaaagaaugggaucucuucguggagcggagcacggccuauuccaacuguuacccuuaugacguucccgauuacgcuucucugcgcagccuuguggccuccagcggcacccuggaauuuaauaacgagucuuucaauuggacaggggucgaccagaacggaaccuccagcgcuugcaagagacggucuaauaaauccuuuuucagccgccucaacuggcugcaccaacuuaaguauaaguacccugcccugaaugugacaaugcccaacaacgagaaauuugauaagcucuauauuuggggcguucaucacccuucuaccgacuccgaucagaucagccuguacgcgcaggccuccggcagagugacggucucuacaaaacggagccagcaaaccgugauuccgaauaucgggucccgccccugggugagaggagucagcucucggauuuccaucuacuggacaauuguuaagccuggcgacauccugcucaucaacagcaccgggaaucugauugcuccccgcggauauuucaaaaucagaucuggcaagagcuccauuaugcggucuaacgccccuaucgggaaguguaauagcgaaugcauuacccccaacggauccaucccgaaugacaaaccuuuucagaacgugaaucgcaucacauacggcgcuugucccagauaugugaagcagaacacgcuuaaacuggccaccggcaugcggaaugucccugagaagcagacacgcgggauuuucggagcgaucgccggcuuuauugaaaacgggugggagggaaugguggauggcugguacggguucagacaccaaaauagcgagggaaccggccaggcugccgaccucaaaucuacacaggcugccaucaaccaaauuaauggcaagcugaaccggcuuaucgagaaaaccaacgaaaaguuucaucagaucgaaaaggaguucuccgaaguugaggggcgcauucaggaucuggagaaauauguggaagacacgaagaucgaucucuggagcuacaaugccgagcugcuggucgcucucgaaaaccagcacacaauugaccugaccgauucugagaugaauaaacuuuucgaaagaacccggaagcaacugagagagaacgcggaggacaugggaaauggcugcuuuaaaaucuaucauaagugugauaacgccugcauuggguccauccgcaauggaacauacgaccacgauguguaccgggacgaagcucucaacaauagauuccagauuaagggcguugagcugaaaagcggguauaaggacuggauccuuuggaucuccuuugccauuucuugcuuccugcucugugugguccugcugggcuuuaucaugugggccugccagaaaggaaacauucgcuguaauaucugcauuuga

SEQ ID NO: 191706 - RNA, 1701 nt, Artificial Sequence
  derived and/or modified sequence opt5 from hemagglutinin__InfluenzaA__AFH00582
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugcgcgagaacgccgaggacauggggaauggauguuuuaagaucuaucauaaaugcgauaacgcuugcauuggcucuauccggaaugggaccuacgaccacgaugucuacagagacgaagcccucaacaaucgcuuccagauuaagggcguggagcugaaauccggauauaaggacuggauccuuuggaucagcuuugccacauccuguuuccugcucugcguugugcugcugggcuuuauuaugugggcuugucagaaagggaacauccggugcaauauuuguaucuga

SEQ ID NO: 191707 - RNA, 1701 nt, Artificial Sequence; identical to SEQ ID NO: 184329
  derived and/or modified sequence opt5 from hemagglutinin__InfluenzaA__AFH00593

SEQ ID NO: 191708 - RNA, 1701 nt, Artificial Sequence; identical to SEQ ID NO: 184329
  derived and/or modified sequence opt5 from hemagglutinin__InfluenzaA__AFH00604

SEQ ID NO: 191709 - RNA, 1701 nt, Artificial Sequence
  derived and/or modified sequence opt5 from hemagglutinin__InfluenzaA__AFH00615
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaaguccuuuuucagccggcugaacuggcucacacaucugaaauauaaguacccugcccuuaaugucaccaugcccaacaacgagaaauuugauaagcuguauaucuggggagugcaccauccugggacggacucugaucagauuucccucuacgcgcaggccagcggccgcaucacaguuuccaccaaaagaucucaacagacagugauuccgaauaucgggagccggccccgcgucagagacauuuccagccggaucucuaucuacuggaccauugugaagccuggagauauccugcugauuaacuccaccggcaaucucaucgcuccccgcggguauuucaagauuagaagcggaaaaucuagcaucaugcgguccgacgccccuaucggcaaguguaacucugagugcauuacacccaauggcagcaucccgaacgacaaaccuuuucagaaugugaaccgcauuacguacggggcuugucccagauaugucaagcagaauacccugaaacuugccacaggaaugcggaacguuccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaaguggaggggagaauccaggauauugaaaaauaugucgaggacacaaagaucgaucuuugguccuacaacgccgagcugcucguggcucuggaaaaucaacauaccauugaccugaccgauagcgagaugaacaaacucuucgaacgcacaaagaagcagcugcgggagaaugcggaagacaugggaaacggcugcuuuaaaaucuaucacaagugugauaaugccugcaucgagucuauuagaaacgggaccuacgaccaugauguuuaccgcgacgaggcucuuaauaaccgguuccagaucaaaggcguggaacugaaguccggauauaaagacuggauucucuggaucagcuuugccauuuccugcuuccugcuuugugucgcccugcucggcuuuaucaugugggcuugccagaaggggaauaucagauguaacauuugcaucuga

SEQ ID NO: 191710 - RNA, 1701 nt, Artificial Sequence; identical to SEQ ID NO: 191301
  derived and/or modified sequence opt5 from hemagglutinin__InfluenzaA__AFH00626

SEQ ID NO: 191711 - RNA, 1701 nt, Artificial Sequence
  derived and/or modified sequence opt5 from hemagglutinin__InfluenzaA__AFH00637
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcucuugcaagcgcagauccaacaauagcuuuuucucucggcugaacuggcucacacaucugaaguuuaaauauccugcucuuaaugucaccaugcccaacaacgagaaguucgacaaacuguacaucuggggagugcaccauccugggacgaauaacgaucagauuucccucuauacacaggccagcggccgcaucaccguuuccacaaagagaucucaacagaccgugauuccgaauaucgggagccggccccgcgucagagacauuccuucccggaucagcaucuacuggaccauugugaaacccggagauauccugcugauuaacucuacaggcaaucucaucgcgccucgcggguacuuuaagauuagauccggaaagagcucuaucaugcggagcgacgcccccaucggcaaauguaacuccgagugcauuacgccgaauggcucuaucccuaacgacaagcccuuccagaaugugaaccgcauuaccuauggggcuuguccuagauacgucaaacagaauacacugaaacuugccaccggaaugcggaacguucccgaaaaacaaacacgcggcaucuuuggggcuauugccggauucaucgagaauggcugggaagggaugguggauggaugguauggcuuuagacaccagaacagcgagggcaucgggcaggcggccgaccugaaguccacccaagcugccauuaaucagaucaacggaaaacucaaccggcugauuggcaagacgaaugagaaguuccaccagaucgaaaaagaguucagcgaaguggaggggcgcauucaggaucuugaaaaguacgucgaggacacaaaaaucgaucuguggucuuauaacgcugagcuccugguggcccuggaaaaucaacauaccauugaccucaccgauuccgagaugaacaagcuguuugaaagaacaaagaagcagcuucgggagaaugccgaagacaugggaaacggcugcuucaagaucuaccacaaaugugauaaugcuugcaucgggagcauuagaaacggcaccuaugaccaugauguuuaccgcgacgaggcgcugaauaaccgguuucagaucaagggaguggagcucaaaucuggcuacaaggacuggauucuguggaucuccuucgccauuagcugcuuucuucugugugucgcucuccugggguucaucaugugggccugccagaaaggaaauaucagauguaacauuugcaucuga

SEQ ID NO: 191712 - RNA, 1701 nt, Artificial Sequence
  derived and/or modified sequence opt5 from hemagglutinin__InfluenzaA__AFH00648
augaagaccaucauugcccugagcuacauccucugccugguguucgcucagaaacuucccggcaacgacgauuccacagccacgcugugucucgggcaccaugcggucccuaauggaaccauuguuaagacaaucaccaacgaccaaauugaggugacaaaugcuaccgaacuggugcagucuagcuccacaggcgggaucugcgauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaaugaugaaucuuucaacuggaccggcgugacacagaauggcaccuccagcucuugcaagcgcagauccaacaauagcuuuuucucucggcugaacuggcucacacaucugaaguuuaaauauccugcucuuaaugucaccaugcccaacaaugagaaguucgacaaacuguacaucuggggagugcaccauccuguuacggauaacgaccagauuuuucucuaugcccaggcguccgggcgcaucacagugagcaccaagagaucccaacagacagucauuccgaacaucggcucucggccccgcauuagaaauaucccuagccggaucuccauuuacuggaccaucgugaaacccggggacauucugcugaucaacagcaccggaaaucucauugccccucgcggcuacuucaagaucagaucugggaaguccagcaucaugcggucugaugcucccauuggaaaauguaacagcgagugcaucacaccgaauggcuccauuccuaacgacaagcccuuucagaaugugaaccgcaucacguauggcgccuguccuagauacgucaaacagaauacccugaagcuggcuacagggaugcggaacguucccgaaaaacaaacccgcggaauuuucggcgccaucgcgggguuuaucgagaauggaugggaaggcaugguggaugggugguauggauucagacaccagaacucugagggcauuggccaggccgcugaccuuaagagcacacaagccgcuaucaaucagauuaacgggaaacucaaucggcugaucggaaagaccaacgagaaguuccaccagauugaaaaagaguuuuccgaaguggagggcagaauccaggaucuugaaaaguacgucgaggacacgaaaauugaucuguggagcuauaacgccgagcuccugguggcccuggaaaaucaacauacaaucgaccucaccgauucugagaugaacaagcuguucgaacgcaccaaaaagcagcuucgggagaaugcugaagacauggggaacggaugcuuuaagaucuaccacaaaugugauaaugcgugcauuggcuccaucagaaacgggacauaugaccaugacguuuaccgcgaugaggcccugaauaaccgguuccagauuaagggcguggagcucaaaagcggauacaaggacuggauccuguggauuucuuuugcuaucuccugcuuccuucugugugucgcccuccugggcuuuaucaugugggccugccagaaagggaauauuagauguaacaucugcauuuga

SEQ ID NO: 191713 - RNA, 1701 nt, Artificial Sequence
  derived and/or modified sequence opt5 from hemagglutinin__InfluenzaA__AFH00659
augaagaccaucauugcccugagcuacauccucugccugguguucacacagaaacuucccggcaacgacaauuccacggcuacccugugucucgggcaccaugccgucccuaacggaacaaugguuaagaccauuacaaaugaucaaaucgaggugaccaacgcgacagaacuggugcagucuagcuccaccggcgagauuugcgacucuccgcaccagauccuugauggggaaaauuguacgcugaucgacgcucuccugggagauccccagugcgacggcuuucaaaacaaaaagugggaucuguucgucgagagaagcaaagcccauuccaauuguuauccuuacgacgugcccgauuaugccucucuccggagccugauugcuuccagcgggacccuugaauuuaacaaugagucuuucaacuggacaggaguuacccagaauggcacauccagcgccugcaagcgcagaucugacaacuccuuuuucagccggcugaauuggcucacccaccugaaguuuaaauacccugcucuuaacgugacgaugcccaauaacgaggaguucgauaagcuguauaucuggggcguccaucacccugggacagacaacgaucagauuucucucuacgcccaggcguccggacgcaucaccgugagcacaaaaagaucccaacagaccguuauuccgaauaucggcucucggccccgcgugagagacauuccuagccggaucuccaucuauuggaccauugucaagcccggggacauccugcugauuaacagcacaggaaaucucaucgccccucgcggcuacuuuaaaauuagaucugggaaguccagcaucaugcggucugaugcucccaucggaaaguguaacagcggcugcauuacgccgaauggcuccaucccuaacgacaaacccuuccagaaugugaaccgcauuaccuacggggccuguccuagauaugugaagcagaauacacugaaacuugcuaccggaaugcggaacguccccgaaaagcaaacacgcggcaucuuuggggccauugcgggauucaucgaaaauggcugggaggggaugguugauggaugguacggcuuuagacaccagaacucugagggcaucgggcaggccgcugaccugaaaagcacccaagccgcuauugaucagaucaauggaaagcucaaccggcugauuggcaaaacgaaugaaaaguuccaucagaucgagaaggaguucuccgaaguggaagggcgcauucaggaccuugagaaauauguggaggauacaaagaucgaccuguggagcuacaacgccgaacuccuggucgcccuggagaaccaacacaccauugaucucaccgacucugaaaugaauaaacuguuugagagaacaaagaaacagcuucgggaaaacgcugaggauaugggaaauggcugcuucaagaucuaucauaagugugacaacgcgugcaucggguccauuagaaauggcaccuacgaccacgauguguaucgcgacgaggcccugaacaaucgguuucagaucaaaggaguugaacucaagagcggcuacaaagauuggauucuguggaucucuuucgcuauuuccugcuuucuucuguguguggcccuccugggguucaucaugugggccugccagaagggaaacaucagauguaauauuugcaucuga

SEQ ID NO: 191714 - RNA, 1701 nt, Artificial Sequence
  derived and/or modified sequence opt5 from hemagglutinin__InfluenzaA__AFH00670
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcugcacccuggcacggauaaugaccagaucuuucucuaugcgcaggccucugggcggauuacaguuuccaccaagcgcagccaacagacagugaucccgaacauuggauccagaccccggguccgcaauaucccuucuagaaucagcauuuacuggaccaucgugaagcccggcgauauucugcugaucaacuccaccgggaaucucauugcuccucggggauacuucaaaauccgcagcggcaagucuuccaucaugagaagcgacgcccccauuggcaaguguaacucugaaugcaucacaccgaaugggagcauuccuaacgacaaacccuuucagaaugugaaccggaucacguauggagcuuguccucgcuacgucaagcagaauacccugaaacuugccacaggcaugagaaacguucccgagaagcaaacccgggggauuuucggagcgaucgccggcuuuaucgaaaaugggugggagggaaugguggauggcugguauggcuuccgccaucagaacuccgaggggauuggacaggcugccgaccugaaaucuacacaagcugccaucgaucagauuaauggcaagcucaacagacugaucgggaaaaccaacgaaaaguuccaccagauugagaaggaauuuagcgagguggaaggacggauccaggaccuugagaaauacgucgaggauacgaagauugaccugugguccuauaaugccgaacuccugguggcucuggagaaccaacacacaaucgaucucaccgacagcgaaaugaauaaacuguucgagaagaccaaaaagcagcuuagagaaaacgcggaggauaugggcaaugggugcuuuaagaucuaccauaaaugugacaacgccugcauuggcucuauccgcaauggaacauaugaucacgacguuuaccgggacgaggcucugaacaauagauuccagauuaagggcguggaacucaaauccggguacaaggauuggauccuguggauuagcuuugccaucucuugcuuccuucugugugucgcccuccugggauuuaucaugugggcuugccagaaaggcaacauucgcuguaauaucugcauuuga

SEQ ID NO: 191715 - RNA, 1701 nt, Artificial Sequence
  derived and/or modified sequence opt5 from hemagglutinin__InfluenzaA__AFH00681
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucaucgagagaagcaaagccuauuccaauuguuacccuuaugacguccccgauuacgcuucucuccggagccugguggccuccagcgggacgcuugaauuuaacaaugagucuuucaacuggaccggaguuacacagaauggcaccuccagcgcuugcauucgcagaucuaacaauuccuuuuucagccggcugaacuggcucacacaucugaaguuuaaguauccugcccuuaaugugaccaugcccaacaaagagaaguucgacaaacuguacaucuggggcguccaccauccugggacggauaacgaccagauuuuucucuaugcgcaggccucuggacgcaucacaguguccaccaagagaagccaacagacaguuauuccgaauaucggcucccggccccgcgugagaaacaucccuucucggauuagcaucuacuggaccauugucaaacccggggauauccugcugauuaauuccaccggaaaccucaucgcuccucgcggcuacuucaagaucagaagcgggaagucuuccauuaugcggagcgacgcccccaucggaaaauguaauucugaaugcauuacaccgaacggcagcaucccuaaugacaagcccuuucagaacgugaaucgcauuacguauggcgcuuguccuagauacgugaaacagaacacccugaaacuugccacagggaugcggaauguccccgagaagcaaacccgcggaaucuucggcgcgaucgccggguuuauugaaaacggaugggagggcaugguugaugggugguauggauucagacaccaaaauuccgagggcaucggccaggcugccgaccugaagucuacacaggcugccauugaucagaucaacgggaaacucaaucggcugauuggaaagaccaacgaaaaguuccaccagaucgagaaagaauuuagcgagguggaaggccgcauucaggaccuugagaaguacguggaggauacgaaaaucgaccugugguccuauaacgccgaacuccuggucgcucuggagaaucaacauacaaucgaucucaccgacagcgaaaugaacaagcuguucgagaaaaccaagaagcagcuuagagaaaaugcggaggauauggggaacggaugcuuuaaaauuuaccacaagugugacaaugccugcaucggcucuauucggaacgggacauaugaucaugacguguacagagacgaggcucugaauaaccgcuuccagaucaaaggcguugaacucaaguccggauacaaagauuggauucuguggaucagcuuugccaucucuugcuuccuucuguguguggcccuccugggcuuuauuaugugggcuugccagaaggggaauauccgguguaacauuugcaucuga

SEQ ID NO: 191716 - RNA, 1701 nt, Artificial Sequence; identical to SEQ ID NO: 184952
  derived and/or modified sequence opt5 from hemagglutinin__InfluenzaA__AFH00692

SEQ ID NO: 191717 - RNA, 1701 nt, Artificial Sequence
  derived and/or modified sequence opt5 from hemagglutinin__InfluenzaA__AFH00703
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcaaaaucugcgacucuccgcaccagauccuugaugggaagaauuguacccugauugacgcccuccugggagauccccagugcgacggcuuucaaaacaaaaagugggaucuguucgucgagagaagcaaggccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaaaaacuccuuuuucagccggcugaauuggcucacacaucugaacuuuaaguauucugcccuuaaugucaccaugccuaacaacgaacaguucgacaaacuguacauuuggggcgugcaccaucccgggacggauaaggaccagaucuuucucuaugcgcaagccuccggacgcauuacaguuagcaccaaaagaucccagcagacagugaucccuaauauuggcucucggccgcgcgucagaaacauccccagccggaucuccauuuacuggaccaucgugaagccuggggauauucugcugaucaauagcaccggaaaccucauugcuccccgcggcuacuucaagaugcagucugggaaauccagcaucaugagaucugacgccccuaucggaaaguguaauagcgagugcauuacacccaacggcuccaucccgaaugacaaaccuuuucaaaacgugaaucggauuacguauggcgcuuguccccgcuacgucaagcagaacacccugaaacuugccacagggaugagaaauguuccugagaagcagacccggggaaucuucggcgcgauugccggguuuaucgaaaacggaugggagggcaugguggaugggugguauggauuccgccaccaaaauucugaaggcagaggccaggcugccgaccugaaaagcacacaggcugccaucgaucagauuaacgggaagcucaaucggcugaucggaaagaccaacgagaaauuccaccaaauugagaaggaauuuuccgagguggaaggcagaauccaggaccuugagaaauacgucgaagauacgaagauugaccuguggagcuauaacgccgagcuccugguggcucuggagaaucagcauacaaucgaucucaccgacucugaaaugaacaaacuguucgagaagaccaagaaacagcuucgcgaaaaugcggaggauauggggaacggaugcuuuaagauuuaccacaaaugugacaaugccugcaucggcuccauccggaacgggacauaugaucaugacguuuacagagacgaagcucugaauaaccgcuuccaaauuaagggcguggagcucaaaagcggauacaaggauuggauccuguggauuucuuuugccaucuccugcuuccuucugugugucgcccuccugggcuuuauuaugugggcuugccagaaggggaauauccgguguaacaucugcauuuga

SEQ ID NO: 191718 - RNA, 1701 nt, Artificial Sequence
  derived and/or modified sequence opt5 from hemagglutinin__InfluenzaA__AFH00714
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuauuaaugaaggauucaacuggaccggcgugacacagucuggcggguccuacgcuugcaaacggggaagcgacaagucuuucuucucccgccugaauuggcucuaugagagcgagucuaaguacccuguccugaacgugaccaugcccaauaacggcaauuuugauaaacuuuauaucuggggaguucaccauccuuccacagacaaggaacaaaccaaccuguacgugagagccagcgggcgggucacgguguccacaaaacgcucucagcagaccauuaucccgaacauuggcagcagacccugggugcgggggcucuccagcggaaucucuauuuacuggacaaucgucaagccuggcgauauccugcugauuaauuccaacggcaaucucaucgcgccccgcggguauuucaaaauuagaaccggaaagagcucuaucaugcggagcgacgccccuauuggcaccuguuccucugagugcaucacacccaacgggagcaucccgaaugacaagccuuuucagaacguuaauaaaauuacguacggagcuugucccaaguaugugaaacaaaacacccugaagcuggccacaggcaugcgcaaugugccugaaaaacagaccagagggaucuucggagcuauugccggcuuuaucgagaacggcugggaggggauggucgauggaugguacggcuuccggcaccaaaauuccgaagggacaggacaggcggccgaccuuaagagcacccaggcugccauugaucagaucaacggcaaacucaaucgcgugaucgagaagacgaacgaaaaguuccaccagauugagaaagaauuuucugagguugaggggagaauccaagaccuggaaaaguauguggaggauacaaaaauugaccuuugguccuacaaugcugaacugcucgucgcccuggagaaccagcauaccaucgaucugaccgacagcgaaaugaacaagcucuuugagaaaacacggagacagcugcgcgagaaugccgaagauaugggcaacggaugcuuuaagauuuaucacaagugugacaaugcuugcaucggcucuauucggaacgggaccuacgaucaugacguguacagagacgaggcgcuuaauaaccgcuuccagaucaaaggaguugaacugaaguccggcuauaaagauuggauccucuggauuagcuuugccaucuccugcuuccugcuuugugugguccugcucggguuuauuaugugggcuugccaaaagggaaauauccgguguaacauuugcaucuga

SEQ ID NO: 191719 - RNA, 1701 nt, Artificial Sequence
  derived and/or modified sequence opt5 from hemagglutinin__InfluenzaA__AFH00725
augaagaccaucauugcccugagcuacaucuucugccucauuuuugcucagaaccugcccggcaaugacaacuccacagccacgcuuugucuggggcaccaugcggugccuaauggaacccucgucaaaacaaucaccaacgaucaaauugagguuacaaaugcuaccgaacuggugcagucuagcuccacaggcagaaucugcgacucuccgcaccggauccuugaugggaagaacuguacccugauugacgcccuccugggagauccccauugcgacggcuuccagaaugagaaaugggaucuguuuguggaacgcagcaaggccuucuccaacuguuauccuuacgacguccccgauuaugcuucucucagaagccugguggccuccagcgggacgcuugaguuuaucaaugaaggauucaacuggaccggcguuacacagucuggcggguccuacgcuugcaaacggggaagcgacaauucuuucuucucccgccugaacuggcucuaugagagcgagucuaaguacccugugcugaaugucaccaugcccaacaauggcaaguuugauaaacuuuauauuuggggagugcaccauccuuccacagacaaggaacaaaccaaacuguacguuagagccagcgggcgggugacggucuccacaaagcgcucucagcagaccgugaucccgaacauuggcagcagacccugggugcgggggcucuccagccgcaucucuauuuacuggacaaucgucaaaccuggagauauccugcugauuaacuccaccggcaaucucaucgcgcccagaggcuauuucaagauucggaccgggaaguccucuaucaugcgcagcgacgccccuauuggaacauguuccucugagugcaucacgcccaacggcagcaucccgaaugacaaaccuuuucagaacguuaauaagauuaccuacggggcuugucccagauaugugaaacaaaacacacugaagcuggccaccggaaugcggaaugugccugaaaaacagacacgcggcaucuucggggcuauugccggauuuaucgagaacggcugggagggcauggucgaugggugguacggauucagacaccagaauagcgaaggcaccgggcaggcggccgaccuuaagagcacgcaagcugccauugaucagaucaacggaaaacucaaucgggugaucgagaagacaaacgaaaaguuccaccagauugagaaagaauuuucugagguugagggcagaauccaagaccuggaaaaguauguggaggauaccaaaauugaccuuugguccuacaaugcugaacugcucgucgcccuggagaaccagcauaccaucgaucugacagacagcgaaaugaauaagcucuuugagaaaacccgcaagcagcugcgggagaacgccgaagauauggggaacggcugcuuuaagauuuaucacaaaugugacaaugcuugcaucggaucuauuagaaacggcacauacgaucaugacguguaccgcgacgaggcgcuuaauaaccgguuccagaucaaggggguugaacugaaauccggauauaaggauuggauccucuggauuagcuuugccaucuccugcuuccugcuuugugugguccugcucggcuuuauuaugugggcuugccaaaaagggaauaucagauguaacauuugcaucuga

SEQ ID NO: 191720 - RNA, 1701 nt, Artificial Sequence; identical to SEQ ID NO: 190090
  derived and/or modified sequence opt5 from hemagglutinin__InfluenzaA__AFH00736

SEQ ID NO: 191721 - RNA, 1701 nt, Artificial Sequence
  derived and/or modified sequence opt5 from hemagglutinin__InfluenzaA__AFH00747
augaagaccaucauugcccugagcuacaucuucugccucguguuugcucagaaacugcccggcaacgacaauuccacagccacgcuuugucuggggcacuaugcggucccuaacggaacccucguuaagacaauuaccaaugaucaaaucgaggugacaaacgcuaccgaacuggugcagucuagcuccacaggcagaauuugcgacucuccgcaucggauccuugaugggaaaaauuguacccugaucgacgcccuccugggagauccccacugcgacggcuuccagaacgagaagugggaucuguuugucgaacgcagcaaagccuacuccaauuguuauccuuacgacgugcccgauuaugcuucucucagaagccugguugccuccagcgggacgcuugaguucauuaacgaagacuuuaauuggaccggagugacacagucuggcggcuccuacgcuugcaagcgggggagcgucaagucuuucuuuucccgccugaacuggcuccaugagagcgaguauaaauacccugcccugaaugugaccaugcccaacaauggaaaguucgauaaacuuuacaucuggggcguucaccauccuucuacagacagagaacaaaccaaccuguaugugcgggcguccgggcgcgucacggugagcacaaagagaucccagcagaccgugauuccgaauaucggaucucggcccuggguccgcggccucagcuccagaauuagcaucuacuggacaauuguuaaaccuggggauauccugcugaucaacucuaccggaaaccucauugcuccccggggcuauuuuaagauccgcaccggcaaguccagcauuaugagaucugacgccccuaucgggacauguagcuccgagugcauuacgcccaauggaucuaucccgaacgacaaaccuuuccagaaugugaacaagaucaccuacggcgccuguccccgguaugugaaacaaaauacacugaaacuugcuaccgggaugcgcaacgucccugaaaagcagacaagaggaauuuuuggcgccaucgcgggguucauugagaauggaugggagggcaugguggauggcugguacggguuucggcaccagaacagcgaaggaaccggccaggccgcugaccugaaguccacgcaagccgcuaucgaucagauuaaugggaaacucaacagacugaucgagaagacaaaugaaaaguuccaccagaucgagaaagaguucagcgaaguugagggacgcauucaagaccuugaaaaguauguggaggauaccaaaaucgaccuguggucuuacaacgccgaacuccuggucgcccuggagaaucagcauaccauugaucucacagacuccgaaaugaacaagcuguuugagaaaacccggaagcagcuuagagagaaugcugaagauaugggcaacgggugcuucaagaucuaccacaaaugugacaacgcgugcauuggcagcauccgcaauggaacauaugaucaugacguguaccgggacgaggcccugaacaauagauuucagauuaagggcguugaacucaaaucuggguauaaggauuggauccuguggaucuccuucgcuauuagcugcuuucuucugugugugguccuccugggauucaucaugugggccugccaaaaaggcaacauucgcuguaauaucugcauuuga

SEQ ID NO: 191722 - RNA, 1701 nt, Artificial Sequence
  derived and/or modified sequence opt5 from hemagglutinin__InfluenzaA__AFH00758
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuaugccugcaagcggggcagcgucaaguccuuuuucucucgccucaacuggcugcacgagagcgaauacaaauauccugcgcuuaaugugacaaugcccaacaaugggaaguuugauaaacuguacaucuggggaguucaucacccuucuaccgacagagagcaaacaaagcucuacgugcgggccuccggccgcgucaccgugagcacgaaaagaucccagcagacagugauuccgaacaucgggucucggcccuggguccgcggacugagcuccagaauuagcaucuauuggaccauuguuaagccuggcgauauccugcucaucaauucuacagggaaccugauugcuccccggggauacuucaagauccgcaccggcaaauccagcauuaugagaucugacgccccuaucggcaccuguagcuccgaaugcauuacacccaacgggucuaucccgaaugacaagccuuuucagaacgugaaucggaucacguauggagcuuguccccgcuacgugaaacaaaacacccuuaagcuggccacaggcaugagaaaugucccugagaaacagacccgggggauuuucggagcgaucgccggcuuuauugagaacgggugggaaggaaugguggauggcugguauggcuucagacaccagaauagcgaggggacaggacaggcugccgaccucaaguccacccaagcugccaucgaucagauuaacggcaaacugaaucgccuuaucgaaaagacgaacgagaaguuucaucagaucgaaaaagaguucagcgagguugaagggcggauucaagaccuggagaaguacguggaagauacaaaaaucgaccucuggucuuauaaugccgagcugcuggucgcucucgaaaaccagcacaccauugaucugaccgacuccgagaugaauaaacuuuucgagaagacaagaaagcagcugcgcgaaaacgcggaggauaugggaaauggcugcuuuaagaucuaccauaaaugugacaacgccugcauugggagcauccggaacggcaccuacgaucacgacguguauagagacgaagcucucaauaaccgcuuccagauuaagggaguugagcugaaaucuggcuacaaggauuggauccuuuggaucuccuuugccauuagcugcuuccugcucugugugguccugcugggguuuaucaugugggccugccaaaaaggaaauauucgguguaacaucugcauuuga

SEQ ID NO: 191723 - RNA, 1701 nt, Artificial Sequence
  derived and/or modified sequence opt5 from hemagglutinin__InfluenzaA__AFH00769
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuauacaugcaagcggggcagcgucaaguccuuuuucucucgccucaacuggcugcacgagagcgaauacaaauauccugcccuuaaugugaccaugcccaacaaugauaaguuugacaaacuguacaucuggggaguucaucacccuucuacagauagagagcaaaccucccucuacauucgggcgagcgggcgcgugacggucuccacaaagagaucucagcagaccgugaucccgaacauuggcagccggcccugggugcgcgggcuguccagcagaaucucuauuuauuggacaaucgucaaaccuggagacauccugcucauuaauuccaccggcaaccugaucgcuccccggggguacuucaagauucgcaccggaaagagcucuaucaugagaagcgacgccccuauuggcacauguuccucugaaugcaucacgcccaacggcagcaucccgaaugauaaaccuuuucagaacguuaaucggauuaccuauggggccuguccccgcuacgugaagcaaaacacacuuaaacuggcuaccggaaugagaaaugugccugagaagcagacacggggcaucuucggggccauugcgggauuuaucgagaacggcugggaagggauggucgacggaugguauggcuucagacaccaaaauuccgagggcaccgggcaggccgcugaucucaaaagcacgcaggccgcuauugaccagaucaacggaaagcugaaucgccuuaucgagaaaacaaacgaaaaguuucaucagauugaaaaggaguucucugagguggaaggccggauccaagaucuggagaaauacguugaagacaccaagauugaucucugguccuauaaugccgagcugcugguggcccucgaaaaccagcacaccaucgaccugacagauagcgagaugaauaaacuuuucgagaagaccagaaaacagcugcgcgaaaacgcugaggacauggggaauggaugcuuuaagauuuaccauaagugugauaacgcgugcaucggcucuauucggaacgggacauacgaccacgacgucuauagagaugaagcccucaauaaccgcuuccagaucaaaggcguggagcugaaguccggauacaaagacuggauccuuuggauuagcuuugcuaucuccugcuuccugcucuguguugugcugcugggcuuuauuaugugggccugccaaaaggggaauauccgguguaacauuugcaucuga

SEQ ID NO: 191724 - RNA, 1701 nt, Artificial Sequence
  derived and/or modified sequence opt5 from hemagglutinin__InfluenzaA__AFH00780
augagagccaucauugcucugagcuacauccucugccugguguucgcccagaaacuucccggcaacgacaauuccaccgcgacacugugucucgggcaccaugcugucccuaacggaacgcugguuaagaccauuacaaaugaucaaaucgaggugaccaacgccacagaacuugugcagucuagcuccaccggccggauuugcgacucuccgcaccgcauccuggaugggaagaauuguacacucaucgacgcccugcugggagauccccauugcgacggcuuucagaacaaagagugggaucucuucgucgaaagaagcaaggcuuauuccgacuguuacccuuaugaugugcccgacuacgccucucugcggagccuuguugcuuccagcgggacccuggaguuuacgaaugaaggauucaacuggaccggcguggcccaggauggcacaucuuaugcgugcaaacgcggguccgucaagagcuuuuucucuagacucaauuggcugcacaaacuugaguacaaguauccugcccugaacgugaccaugcccaauaacgacaaguuugauaaacucuacauuuggggaguucaucacccuuccacagacagcgaccaaaccucucuguacgugcaggcuuccggccgggucacggugagcacaaagcgcucccagcagaccgugaucccgaauauugggucuagacccuggguccggggaguuagcucccgcaucagcauuuauuggacaaucgugaaaccuggcgauauucugcucaucaacucuaccgggaaucugaucgcccccagaggauacuucaagauucgguccggcaagagcucuaucaugcgcagcgacgcuccuauuggcaacuguaacuccgagugcaucacccccaaugggucuauuccgaacgauaaaccuuuucaaaaugugaacagaaucacauauggagccuguccccgguacgucaagcagaauacgcuuaaacuggcgaccggcaugcgcaacgugccugaaaagcagacaagagggaucuucggagccauugcuggcuuuaucgagaaugggugggaaggaaugguugacggcugguauggcuuccggcaccagaacagcgaggggaccggacaagccgcugaucucaaauccacacaggccgccauuaaucagaucaacggcaagcugaauagacuuauugagaaaaccaacgaaaaguuucaucaaaucgagaaggaguucagcgaaguggaagggcgcauccaggaccuggagaaauacgucgaggauacgaagauugaccucuggucuuauaaugcugaacugcugguggcgcucgagaaccagcacacaaucgaucugaccgacuccgaaaugaauaaacuuuucgagcggaccagaaagcagcugcgcgaaaacgccgaggauaugggaaacggcugcuuuaaaauuuaccauaagugugacaaugcuugcaucgggagcauucggaacggcacauacgaccacgauguuuauagagacgaggcccucaauaaccgcuuccaaaucaagggaguggaacugaaaucuggcuacaaggauuggauucuuuggaucuccuuugccaucagcugcuuccugcucugugucgugcugcugggguuuauuaugugggcuugccagaaaggaaauauccgguguaacauuugcaucuga

SEQ ID NO: 191725 - RNA, 1701 nt, Artificial Sequence
  derived and/or modified sequence opt5 from hemagglutinin__InfluenzaA__AFH00791
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagggcucuagcacagggagaauuugcgacuccccgcaccagauccuggauggaaagaauuguacccucaucgacgcccugcugggcgauccccauugcgacggguuucagaacaaggagugggaucucuucgucgaacggucuacggccuauagcaauuguuacccuuaugacgugcccgauuacgcuucccugcgcucucuuguugccagcuccggaacccuggaguuuacaaaagaaggcuucaacuggaccggcguggcucaagacgggacaagcuauaccugcaagagaggaucugucaaguccuuuuucagccggcucaauuggcugcacaaacuugaguacaaguauccugcccugaacgugacgaugcccaauaacgauaaauuugacaagcucuacauuuggggcguucaucacccuucuacagauuccgaccagaccagccuguacgugcaggcgucugggcgcgucacaguguccaccaaaagaagccagcaaaccgugaucccgaauauuggaucccggcccuggguccgcggcguuucuagcagaaucuccauuuauuggacaaucgugaagccuggggacauucugcucaucaacagcacgggaaaucugaucgcuccccggggcuacuucaagauucgcucuggcaaauccagcaucaugagaucugaugccccuauugacaacuguaacagcgagugcaucacccccaauggguccauuccgaacgauaagccuuuucagaaugugaaccggaucacauauggagccuguccccgcuacgucaaacagaauacccuuaagcuggcuacaggcaugagaaacgugccugaaaaacagacccgggggaucuucggagccauugcgggcuuuaucgagaaugggugggaaggaaugguugacggcugguauggcuuccgccaccaaaacucugaggggacgggacaggccgcugaucucaagagcacacaggccgcuauuaaucaaaucaacggcaaacugaauagacuuauugagaagaccaacgaaaaguuucaucagaucgagaaagaguucuccgaaguggaagggcggauccaggaccuggagaaguacgucgaggauaccaaaauugaccucuggagcuauaaugccgaacugcugguggcccucgagaaccagcacacaaucgaucugaccgacucugaaaugaauaaacuuuucgagagaacacgcaaacaacugcgggaaaacgcugaggauaugggaaacggcugcuuuaagauuuaccauaagugugacaaugcgugcaucggguccauuagaaacggcacguacgaccacgauguuuaucgcgacgaggcccucaauaaccgguuccagaucaaaggaguggaacuuaagagcggcuacaaagauuggauucuguggaucucuuuugcuaucuccugcuuccugcucugugucgugcugcugggguuuauuaugugggccugccagaagggaaauaucagauguaacauuugcaucuga

SEQ ID NO: 191726 - RNA, 1701 nt, Artificial Sequence; identical to SEQ ID NO: 184366
  derived and/or modified sequence opt5 from hemagglutinin__InfluenzaA__AFH00802

SEQ ID NO: 191727 - RNA, 1701 nt, Artificial Sequence
  derived and/or modified sequence opt5 from hemagglutinin__InfluenzaA__AFH00813
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagagacaucccuucucgggugagcaucuauuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugccugcauuaccccgaauggcagcaucccuaacgacaagcccuuucagaaugucaaccgcauuacauacggcgcguguccuagauauguuaaacaaaauacgcugaaacuugccaccgggaugcggaacgugcccgaaaaacagacacgcggaaucuucggcgcuauugccggguuuaucgagaauggaugggaaggcaugguggaugggugguacggauucagacaccagaacuccgagggccggggccaagcugccgaccugaagucuacccaggccgcuaucgaucagauuaaugggaaacucaacagacugaucggaaagacaaacgagaaauuccaucagauugaaaaggaguuuagcgaagucgagggccgcauccaagaccuugaaaaguauguggaggauaccaaaauugaccugugguccuacaaugcggagcuccugguugcccuggaaaaccagcacacgaucgaucucacagacagcgagaugaauaagcuguucgaaaagaccaagaaacagcuucgggagaacgcugaagauauggggaauggaugcuuuaagauuuaucauaagugugacaacgccugcaucggcucuaucagaaaugggaccuacgaucacgacguguaucgcgacgaggcccugaacaaucgguuccagauuaaaggcgucgagcucaaguccggauacaaagauuggauccuguggauuagcuuugcuaucucuugcuuccuucuguguguggcccuccugggcuuuauuaugugggcgugccaaaaggggaacaucagauguaauaucugcauuuga

SEQ ID NO: 191728 - RNA, 1701 nt, Artificial Sequence
  derived and/or modified sequence opt5 from hemagglutinin__InfluenzaA__AFH00824
augaagaccaucauugcccugagcuacauccucagacugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcaaaauucuagcaucggcgagaucuguaacuccccgcaccagauucuugacggggaaaauugcacacugaucgaugcccuccugggagacccccagugugauggcuuucagaacaaaaagugggaccuguucgucgagcggucuaaagccuauagcaauugcuacccuuaugaugugcccgacuacgcuucccuccgcucucugguugccagcuccgggacccuugaauuuaacaaugagagcuucaacuggacgggagugacccagaauggcacaucuuccgcuuguauuagacggagcaacaauuccuuuuucucucgccugaacuggcucacccaucugaacuuuaaguauccugcccuuaaugucacaaugcccaacaaugagcaguucgauaagcuguacaucuggggcgugcaccauccugggaccgacaaagaucagauuuuucucuaugcgcaaagcucuggaagaaucacgguuuccacaaagcggagccagcaggccgugauuccgaacaucggcucccgccccagaauccgggacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaagugcaauucugaauguaucaccccgaacggcagcauuccuaaugacaagcccuuucagaacgugaauagaaucaccuauggcgcuugcccucgguacgugaaacaauccacacugaagcuggccacggggaugcgcaacguccccgagaaacagaccagaggaaucuucggcgcgauugccggguuuaucgaaaauggaugggagggcaugguugaugggugguauggauuccggcaccagaacucugagggcagaggccaagcugccgaccuuaagagcacacaggcugccauugaucagaucaaugggaaacucaaccgccugauuggaaagaccaacgaaaaauuccaccagaucgagaaggaauuuuccgagguggaaggccggauucaagaccuugagaaguacguggaggauacaaaaaucgaccuguggagcuauaaugccgaacuccuggucgcucuggagaaccagcauaccaucgaucucacggacucugaaaugaauaagcuguucgagaaaacaaagaaacagcuuagagaaaacgcggaggauauggggaauggauguuuuaagauuuaccacaagugcgacaacgccuguaucggcuccauucgcaaugggaccuaugaucaugacguguaccgggacgaggcucugaacaauagauuccagaucaaaggcguugaacucaagagcggauacaaagauuggauucuguggaucucuuuugccaucuccugcuuccuucugugcguggcccuccugggcuuuauuaugugggcuugucaaaaggggaacauccgcugcaauauuuguaucuga

SEQ ID NO: 191729 - RNA, 1701 nt, Artificial Sequence
  derived and/or modified sequence opt5 from hemagglutinin__InfluenzaA__AFH01407
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaaguccuuuuucagccggcugaacuggcucacacaucugaaauauaaguacccugcccuuaaugucaccaugcccaacaacgagaaauuugauaagcuguauaucuggggagugcaccauccugggacggacucugaucagauuucccucuacgcgcaggccagcggccgcaucacaguuuccaccaaaagaucucaacagacagugauuccgaauaucgggagccggccccgcgucagagacauuuccagccggaucucuaucuacuggaccauugugaagccuggagauauccugcugauuaacuccaccggcaaucucaucgcuccccgcggguauuucaagauuagaagcggaaaaucuagcaucaugcgguccgacgccccuaucggcaaguguaacucugagugcauuacacccaauggcagcaucccgaacgacaaaccuuuucagaaugugaaccgcauuacguacggggcuugucccagauaugucaagcagaauacccugaaacuugccacaggaaugcggaacguuccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaaguggaggggagaauccaggaucuugaaaaauaugucgaggacacaaagauugaucugugguccuacaacgccgagcuccugguggcucuggaaaaucaacauaccaucgaccucaccgauagcgagaugaacaaacuguucgaacgcacaaagaagcagcuucgggagaaugcggaagacaugggaaacggcugcuuuaaaauuuaucacaagugugauaaugccugcaucgagucuaucagaaacgggaccuacgaccaugauguuuaccgcgacgaggcucugaauaaccgguuccagauuaaaggcguggaacucaaguccggauauaaagacuggauccuguggauuagcuuugccaucuccugcuuccuucugugugucgcccuccugggcuuuauuaugugggcuugccagaaggggaauaucagauguaacaucugcauuuga

SEQ ID NO: 191730 - RNA, 1701 nt, Artificial Sequence
  derived and/or modified sequence opt5 from hemagglutinin__InfluenzaA__AFH34940
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagggagcgaaaugaauaagcuguucgagaaaaccaagaaacagcuucgggaaaacgcggaggacaugggaaauggcugcuuuaagaucuaccacaagugugauaacgccugcauugggucuaucagaaauggcaccuauaaccaugacguguaccgcgaugaggcucugaauaaccgguuccagauuaaaggaguugaacucaaguccggcuacaaagacuggauccuguggauuagcuuugccaucuccugcuuccuucuguguguggcccuccugggguuuaucaugugggcuugccaaaagggaaauauuagauguaacaucugcauuuga

SEQ ID NO: 191731 - RNA, 1701 nt, Artificial Sequence
  derived and/or modified sequence opt5 from hemagglutinin__InfluenzaA__AFH34961
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccgcuuccgggacgcuugaauuuaacaaugagagcuucaacuggaccggagugacacagaauggcaccucuuccgccugcauccgcagaagcaacucuuccuuuuucagccggcugaauuggcucacacaucugaacuuuaaguauccugcgcuuaaugucaccaugcccaacaacgagcaguucgacaagcuguacauuuggggcgugcaccauccugggacggauaaagaccagaucuuucucuaugcccaaucuuccggacgcauuacaguuagcaccaagagaucccagcaggcugugaucccgaauauuggcucucggccccgcaucagaaacaucccuagccggauuuccaucuacuggacaauugucaaacccggggauauccugcugauuaauagcaccggaaaccucaucgccccucgcggcuacuucaagaucagaucugggaaauccagcauuaugcggucugacgcucccaucggaaaguguaauagcgaaugcauuaccccgaacggcuccaucccuaaugacaagcccuuucagaacgugaaucgcauuacauauggcgccuguccuagauacgugaaacaaucuacgcugaaacuugcgaccgggaugcggaacguccccgagaagcagacacgcggaaucuucggcgccaucgcuggguuuauugaaaauggaugggagggcaugguugaugggugguauggauucagacaccagaacagcgagggccggggccaagccgcugaccugaaguccacccaggccgccaucgaucagauuaaugggaaacucaacagacugaucggaaagacaaaugaaaaauuccaccagauugagaaggaauuuagcgagguggaaggccgcauccaagaccuugagaaguacguggaggauaccaaaauugaccuguggucuuauaacgcugaacuccuggucgcgcuggagaaccagcauacgaucgaucucacagacuccgaaaugaauaagcuguucgagaaaaccaagaaacagcuucgggaaaacgccgaggauauggggaauggaugcuuuaagaucuaccacaagugugacaacgcuugcauuggcagcaucagaaaugggaccuauaaccaugauguguaccgcgacgaggcccugaauaaccgguuccagauuaaaggcguugaacucaagucuggauacaaagacuggauccuguggauuuccuuugccaucagcugcuuccuucuguguguggcucuccugggcuuuaucaugugggccugccaaaaggggaauauuagauguaacaucugcauuuga

SEQ ID NO: 191732 - RNA, 1701 nt, Artificial Sequence
  derived and/or modified sequence opt5 from hemagglutinin__InfluenzaA__AFH34968
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccgcuuccgggacgcuugaauuuaacaaugagagcuucaacuggaccggagugacacagaauggcaccucuuccgccugcauccgcagaagcaacucuuccuuuuucagccggcugaauuggcucacacaucugaacuuuaaguauccugcgcuuaaugucaccaugcccaacaacgagcaguucgacaagcuguacauuuggggcgugcaccauccugggacggauaaagaccagaucuuucucuaugcccaaucuuccggacgcauuacaguuagcaccaagagaucccagcaggcugugaucccgaauauuggcucucggccccgcaucagagauaucccuagccggauuuccaucuacuggacaauugucaaacccggggacauccugcugauuaacagcaccggaaaucucaucgccccucgcggcuacuucaagaucagaucugggaaauccagcauuaugcggucugacgcucccaucggaaaguguaacagcgccugcauuaccccgaauggcuccaucccuaacgauaagcccuuucagaaugugaaccgcauuacauauggcgcguguccuagauacgugaaacaaucuacgcugaaacuugccaccgggaugcggaauguccccgaaaaacagacacgcggaaucuucggcgcuaucgccggguuuauugagaacggaugggaaggcaugguugacgggugguauggauucagacaccagaauagcgagggccggggccaagcugccgaucugaaguccacccaggccgcuaucgaccagauuaacgggaaacucaauagacugaucggaaagacaaacgagaaauuccaccagauugaaaaggaguuuagcgaaguggagggccgcauccaagaucuugaaaaguacguggaggacaccaaaauugaucuguggucuuauaaugcggagcuccuggucgcccuggaaaaccagcauacgaucgaccucacagauuccgagaugaacaagcuguucgaaaagaccaagaaacagcuucgggagaaugcugaagacauggggaacggaugcuuuaagaucuaccacaagugugauaaugccugcauuggcagcaucagaaacgggaccuauaaucaugacguguaccgcgacgaggcccugaacaaucgguuccagauuaaaggcguugagcucaagucuggauacaaagauuggauccuguggauuuccuuugcuaucagcugcuuccuucuguguguggcccuccugggcuuuaucaugugggcgugccaaaaggggaacauuagauguaauaucugcauuuga

SEQ ID NO: 191733 - RNA, 1701 nt, Artificial Sequence
  derived and/or modified sequence opt5 from hemagglutinin__InfluenzaA__AFH34975
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggaacggagugacgcaaaauggcaccucuuccgcuugcauuagacggagcaacaauuccuuuuucucucgccugaacuggcucacacaucugaacuuuaaguauccugcccuuaaugucaccaugcccaacaaugagcaguucgacaagcuguacaucuggggcgugcaccauccugggacagauaaagaccagauuuuucucuaugcgcagccgagcggaagaaucaccguuucuacgaagcggucccaacaggccgugauucccaacaucggcagccgcccuagaauccggaauauucccucccgcaucucuauuuacuggacaaucgucaaaccuggggauauucugcugaucaacagcaccggaaaucucaucgcucccagaggcuacuucaagauucgguccgggaaaagcucuaucaugcgcuccgacgccccgauuggaaaguguaagagcgaaugcaucacaccuaacggcucuauucccaaugacaaaccuuuucagaacgugaauagaaucaccuauggcgcuuguccccgguacgugaagcagagcacccugaaacuugccacagggaugcgcaacguccccgagaagcaaacgagaggaaucuucggcgcgauugccggguuuaucgaaaauggaugggagggcaugguugaugggugguauggauuccggcaccagaacuccgagggcagaggccaggcugccgaccugaaaucuacccaagcugccauugaucagaucaaugggaagcucaaccgccugauuggaaaaacaaacgaaaaguuccaccagaucgagaaggaauuuagcgagguggaaggccggauucaggaccuugagaaauacguggaggauaccaagaucgaccugugguccuauaaugccgaacuccuggucgcucuggagaaccaacauacaaucgaucucaccgacagcgaaaugaauaaacuguucgagaagacgaaaaagcagcuuagagaaaacgcggaggauauggggaauggaugcuuuaagauuuaccacaaaugugacaacgccugcaucggcucuauucgcaaugggacauaugaucaugacguguaccgggacgaggcucugaacaauagauuccagaucaagggcguugaacucaaauccggauacaaggauuggauucuguggaucagcuuugccaucucuugcuuccuucuguguguggcccuccugggcuuuauuaugugggcuugccagaaagggaacauccgcuguaauauuugcaucuga

SEQ ID NO: 191734 - RNA, 1701 nt, Artificial Sequence; identical to SEQ ID NO: 186435
  derived and/or modified sequence opt5 from hemagglutinin__InfluenzaA__AFH74464

SEQ ID NO: 191735 - RNA, 1701 nt, Artificial Sequence; identical to SEQ ID NO: 185693
  derived and/or modified sequence opt5 from hemagglutinin__InfluenzaA__AFH74465

SEQ ID NO: 191736 - RNA, 1701 nt, Artificial Sequence; identical to SEQ ID NO: 186454
  derived and/or modified sequence opt5 from hemagglutinin__InfluenzaA__AFH74477

SEQ ID NO: 191737 - RNA, 1701 nt, Artificial Sequence
  derived and/or modified sequence opt5 from hemagglutinin__InfluenzaA__AFH74488
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacaauccgcaccagauccuugaugggaaaaacuguacccugauugacgcccuccugggagauccccagugcgacggcuuucaaaauaagaaaugggaucuguucgucgaaagaucuaaggccuauagcaacuguuacccuuaugacgugcccgauuacgcuucccuccggucucugguugccagcuccgggacgcuugaguuuaauaacgaaucuuucaauuggaccggagugacacagaacggcaccucuuccgcuugcauccgcagaagcaagaauagcuuuuucucccggcugaacuggcucacacaucugaauuuuaaauauccugcccuuaacgucaccaugcccaacaaugagcaguucgacaagcuguacauuuggggcgugcaccauccugggacggauaaagaccagaucuuucucuaugcgcaagccagcggacgcauuacaguuucuaccaagagaucccagcagacagugaucccgaacauuggcagccggccccgcgucagaaauaucccuucccggaucucuauuuacuggaccaucgugaaacccggggauauucugcugaucaacagcaccggaaaucucauugcuccucgcggcuacuucaagaucagauccggaaagagcucuaucaugcgguccgacgcccccauugggaaauguaacagcgagugcaucacaccgaauggcucuauuccuaacgacaagcccuuucagaaugugaaccgcaucacguauggcgcuuguccuagauacgucaaacaaaauacccugaaacuugccacagggaugcggaacguucccgaaaagcagacccgcggaauuuucggcgcgaucgccggguuuaucgagaauggaugggaaggcaugguggaugggugguauggauucagacaccagaacagcgagggccggggccaagcugccgaccugaaguccacacaggcugccauugaucagaucaaugggaaacucaacagacugauuggaaagaccaacgagaaguuccaccagaucgaaaaagaguuuucugaaguggagggccgcauucaagaccuugaaaaguacgucgaggauacgaaaaucgaccuguggagcuauaaugccgagcuccugguggcucuggaaaaccagcauacaauugaucucaccgacuccgagaugaauaagcuguucgaacggaccaaaaagcagcuuagagagaacgcggaagauauggggaauggaugcuuuaagaucuaccacaaaugugacaacgccugcaucggcagcauucgcaaugggacauaugaucaugacguuuaccgggacgaggcucugaacaauagauuccagaucaagggcguggagcucaaaucuggauacaaggauuggauucuguggaucuccuuugccauuagcugcuuccuucugugugucgcccuccugggcuuuaucaugugggcuugccaaaaagggaacauccgcuguaauauuugcaucuga

SEQ ID NO: 191738 - RNA, 1701 nt, Artificial Sequence; identical to SEQ ID NO: 186435
  derived and/or modified sequence opt5 from hemagglutinin__InfluenzaA__AFH74499

SEQ ID NO: 191739 - RNA, 1701 nt, Artificial Sequence; identical to SEQ ID NO: 186637
  derived and/or modified sequence opt5 from hemagglutinin__InfluenzaA__AFH74510

SEQ ID NO: 191740 - RNA, 1701 nt, Artificial Sequence
  derived and/or modified sequence opt5 from hemagglutinin__InfluenzaA__AFH74521
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcaauucuccgcaccagauucuggacggggaaaacuguacccuuaucgaugcccugcucggagacccccagugcgauggcuuucaaaauaaaaagugggaccuguucgucgagagaagcaaagccuauuccaacuguuacccuuaugaugugcccgacuacgcuucucugcggagccucguugccuccagcgggacgcuggaauuuaauaacgagucuuucaauuggaccggagugacacagaacggcaccuccagcgcuugcauucgcagaucuaauaacuccuuuuucagccggcuuaauuggcugacacauucuaaguccaaguauccugcccucaacgucaccaugcccaacaaugagcaguuugauaaacuguacaucuggggcgugcaccauccugggacggacaacgaucagauuuuccuuuaugcgcaagccagcggacgcaucacaguuuccaccaagagaucucagcagacagugauuccgaauaucggcagccggccccgcaucagagacauuccuucccggaucagcauuuacuggaccaucgucaaacccggggauauucugcucaucaacucuaccggaaaucugaucgcuccucgcggcuacuuuaagauuagauccgggaaaagcucuaucaugaaaagcgacgcccccauuggaaaguguaacuccgaaugcaucacaccgaauggcucuauuccuaacgacaagcccuuccagaaugugaaccggaucacguauggcgcuuguccucgcuacgugaagcaaaauacccugaaacucgccacagggaugagaaacguccccgagaagcagacccggggaaucuuuggcgcgauugccggguucaucgaaaauggaugggagggcaugguugaugggugguauggauuucgccaccagaacagcgagggcagaggccaagcugccgaccugaaauccacacaggcugccauugaucagaucaaugggaaacuuaaccggcugauuggaaagaccaacgaaaaguuccaccagaucgagaaggaguucagcgaaguggaaggccgcauucaagaccucgagaaauacguggaggauacgaaggucgaccuguggucuuauaaugccgaacuucugguggcucucgagaaccagcauacaaucgaucugaccgacuccgaaaugaauaaacuguuugagaagaccaaaaagcagcucagagaaaacgcggaggauauggggaauggaugcuucaagaucuaccacaaaugugacaacgccugcauuggcagcauccggaaugggacauaugaucaugacguuuacagagacgaggcucugaacaaucgcuuucagauuaagggcguggaacuuaaaucuggauacaaggauuggauccuguggauuuccuucgccaucagcugcuuucuccugugugucgcccuucugggcuucaucaugugggcuugccaaaaagggaacauucgguguaauaucugcauuuga

SEQ ID NO: 191741 - RNA, 1701 nt, Artificial Sequence; identical to SEQ ID NO: 190012
  derived and/or modified sequence opt5 from hemagglutinin__InfluenzaA__AFH74532

SEQ ID NO: 191742 - RNA, 1701 nt, Artificial Sequence; identical to SEQ ID NO: 186637
  derived and/or modified sequence opt5 from hemagglutinin__InfluenzaA__AFH74543

SEQ ID NO: 191743 - RNA, 1701 nt, Artificial Sequence; identical to SEQ ID NO: 186637
  derived and/or modified sequence opt5 from hemagglutinin__InfluenzaA__AFH74554

SEQ ID NO: 191744 - RNA, 1701 nt, Artificial Sequence; identical to SEQ ID NO: 186637
  derived and/or modified sequence opt5 from hemagglutinin__InfluenzaA__AFH74565

SEQ ID NO: 191745 - RNA, 1701 nt, Artificial Sequence; identical to SEQ ID NO: 186637
  derived and/or modified sequence opt5 from hemagglutinin__InfluenzaA__AFH74576

SEQ ID NO: 191746 - RNA, 1701 nt, Artificial Sequence; identical to SEQ ID NO: 186637
  derived and/or modified sequence opt5 from hemagglutinin__InfluenzaA__AFH74587

SEQ ID NO: 191747 - RNA, 1701 nt, Artificial Sequence
  derived and/or modified sequence opt5 from hemagglutinin__InfluenzaA__AFH74598
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcaaaaauuguacccugauugacgcccuccugggggauccccagugcgacggauuucaaaacaagaaaugggaucuguucgucgagagaagcaaggccuauuccaauuguuacccuuaugacgugcccgauuacgcuucucuccggagccugguugccuccagcggcacgcuugaauuuaacaaugagucuuucaacuggaccggggugacacagaauggaaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccuggcacggauaaagaccagaucuuucucuaugcgcaagccucugggcgcauuacaguuuccaccaagagaagccagcagacagcuaucccgaauauuggaucccggccccgcgugagaaacaucccuucucggaucagcauuuacuggaccaucgucaaacccggcgauauucugcugaucaauuccaccgggaaccucauugccccucgcggauacuucaagaucagaagcggcaagucuuccaucaugcggagcgacgcucccauugggaaauguaauucugaaugcaucacaccgaacggaagcauuccuaaugacaagcccuuucagaacgugaaucgcaucacguauggcgccuguccuagauacgugaaacaaaacacccugaaacuugcgacaggcaugcggaauguccccgagaagcagacccgcgggauuuucggagccaucgcuggcuuuaucgaaaacgggugggagggaaugguugauggcugguauggguucagacaccaaaauuccgagggacggggccaggccgcugaccugaagucuacacaggccgccauugaucagaucaacggcaaacucaauagacugauugggaagaccaacgaaaaguuccaccagaucgagaaagaauuuagcgagguggaaggacgcauucaagaccuugagaaguacguggaggauacgaaaaucgaccugugguccuauaacgcugaacuccuggucgcgcuggagaaucagcauacaauugaucucaccgacagcgaaaugaacaagcuguucgagaaaaccaagaagcagcuucgggaaaaugccgaggauaugggcaacgggugcuuuaaaaucuaccacaagugugacaaugcuugcaucggaucuauuagaaacggcacauaugaucaugacguguaccgcgacgaggcccugaauaaccgguuccagaucaaagggguugaacucaaguccggcuacaaagauuggauucuguggaucagcuuugccauuucuugcuuccuucuguguguggcucuccugggauuuaucaugugggccugccaaaagggcaauaucagauguaacauuugcaucuga

SEQ ID NO: 191748 - RNA, 1701 nt, Artificial Sequence; identical to SEQ ID NO: 186435
  derived and/or modified sequence opt5 from hemagglutinin__InfluenzaA__AFH74609

SEQ ID NO: 191749 - RNA, 1701 nt, Artificial Sequence; identical to SEQ ID NO: 186637
  derived and/or modified sequence opt5 from hemagglutinin__InfluenzaA__AFH74620

SEQ ID NO: 191750 - RNA, 1701 nt, Artificial Sequence
  derived and/or modified sequence opt5 from hemagglutinin__InfluenzaA__AFH74631
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaccaauuguacgcugauugacgcccuccugggagauccccagugcgacggcuuucaaaacaaaaagugggaucuguucgucgaaagaagcaaagccuauuccaauuguuacccuuaugacgugcccgauuacgcuucucuccggagccugguugccuccagcgggacccuugaguuuaacaaugaaucuuucaacuggacaggagugacccagaauggcacauccagcgcuugcauccgcagaucuaagaacuccuuuuucagccggcugaauuggcucacccaucugaacuuuaaguauccugcccuuaaugucacgaugcccaacaacgagcaguucgacaaacuguacauuuggggcgugcaccauccugggacagauaaggaccagaucuuucucuaugcgcaagccucuggacgcauuaccguuuccacaaaaagaagccagcagaccgcuaucccgaauauuggcucccggccccgcgugagaaacaucccuucucggaucagcauuuacuggaccaucgucaagcccggggauauucugcugaucaauuccacaggaaaccucauugccccucgcggcuacuucaaaaucagaagcgggaagucuuccaucaugcggagcgacgcucccauuggaaaguguaauucugagugcaucacgccgaacggcagcauuccuaaugacaaacccuuucagaacgugaaucgcaucaccuauggcgccuguccuagauacgugaagcaaaacacacugaaacuugcgaccgggaugcggaauguccccgaaaagcagacacgcggaauuuucggcgccaucgcuggguuuaucgagaacggaugggaaggcaugguugaugggugguauggauucagacaccaaaauuccgagggccggggccaggccgcugaccugaaaucuacccaggccgccauugaucagaucaacgggaagcucaauagacugauuggaaaaacgaacgagaaguuccaccagaucgaaaaggaguuuagcgaaguggagggccgcauucaagaccuugaaaaauacguggaggauacaaagaucgaccugugguccuauaacgcugagcuccuggucgcgcuggaaaaucagcauaccauugaucucaccgacagcgagaugaacaaacuguucgaaaagaccaaaaagcagcuucgggagaaugccgaagauauggggaacggaugcuuuaagaucuaccacaaaugugacaaugcuugcaucggcucuauuagaaacgggacauaugaucaugacguguaccgcgacgaggcccugaauaaccgguuccagaucaagggcguugagcucaaauccggauacaaggauuggauucuguggaucagcuuugccauuucuugcuuccuucuguguguggcucuccugggcuuuaucaugugggccugccaaaaagggaauaucagauguaacauuugcaucuga

SEQ ID NO: 191751 - RNA, 1701 nt, Artificial Sequence; identical to SEQ ID NO: 186435
  derived and/or modified sequence opt5 from hemagglutinin__InfluenzaA__AFH74642

SEQ ID NO: 191752 - RNA, 1701 nt, Artificial Sequence; identical to SEQ ID NO: 186435
  derived and/or modified sequence opt5 from hemagglutinin__InfluenzaA__AFH74653

SEQ ID NO: 191753 - RNA, 1701 nt, Artificial Sequence; identical to SEQ ID NO: 186435
  derived and/or modified sequence opt5 from hemagglutinin__InfluenzaA__AFH74664

SEQ ID NO: 191754 - RNA, 1701 nt, Artificial Sequence; identical to SEQ ID NO: 186435
  derived and/or modified sequence opt5 from hemagglutinin__InfluenzaA__AFH74675

SEQ ID NO: 191755 - RNA, 1701 nt, Artificial Sequence; identical to SEQ ID NO: 191183
  derived and/or modified sequence opt5 from hemagglutinin__InfluenzaA__AFH74686

SEQ ID NO: 191756 - RNA, 1701 nt, Artificial Sequence; identical to SEQ ID NO: 191183
  derived and/or modified sequence opt5 from hemagglutinin__InfluenzaA__AFH74697

SEQ ID NO: 191757 - RNA, 1701 nt, Artificial Sequence; identical to SEQ ID NO: 186637
  derived and/or modified sequence opt5 from hemagglutinin__InfluenzaA__AFH74708

SEQ ID NO: 191758 - RNA, 1701 nt, Artificial Sequence; identical to SEQ ID NO: 186637
  derived and/or modified sequence opt5 from hemagglutinin__InfluenzaA__AFH74719

SEQ ID NO: 191759 - RNA, 1701 nt, Artificial Sequence; identical to SEQ ID NO: 186637
  derived and/or modified sequence opt5 from hemagglutinin__InfluenzaA__AFH74730

SEQ ID NO: 191760 - RNA, 1701 nt, Artificial Sequence
  derived and/or modified sequence opt5 from hemagglutinin__InfluenzaA__AFH74741
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugaugggaaaaacuguacccugauugacgcccuccugggagauccccagugcgacggcuuucagaauaagaaaugggaucuguucgucgaaagaucuaaggccuauagcaacuguuacccuuaugacgugcccgauuacgcuucccuccggucucugguugccagcuccgggacgcuugaguuuaauaacgaaucuuucaauuggaccggagugacacagaacggcaccucuuccgcuugcauccgcagaagcaagaauagcuuuuucucccggcugaacuggcucacacaucugaauuuuaaauauccugcccuuaacgucaccaugcccaacaaugagcaguucgacaagcuguacauuuggggcgugcaccauccugggacggauaaagaccagaucuuucucuaugcgcaagccagcggacgcauuacaguuucuaccaagagaucccagcagacagcuaucccgaacauuggcagccggccccgcgugagaaauaucccuucccggaucucuauuuacuggaccaucgucaaacccggggauauucugcugaucaacagcaccggaaaucucauugccccucgcggcuacuucaagaucagauccggaaagagcucuaucaugcgguccgacgcucccauugggaaauguaacagcgagugcaucacaccgaauggcucuauuccuaacgacaagcccuuucagaaugugaaccgcaucacguauggcgccuguccuagauacgugaaacaaaauacccugaaacuugcgacagggaugcggaacguccccgaaaaacagacccgcggaauuuucggcgccaucgcuggguuuaucgagaauggaugggaaggcaugguugaugggugguauggauucagacaccagaacagcgagggccggggccaagccgcugaccugaaguccacacaggccgccauugaucagaucaaugggaaacucaacagacugauuggaaagaccaacgagaaguuccaccagaucgaaaaagaguuuucugaaguggagggccgcauucaagaccuugaaaaguacguggaggauacgaaaaucgaccuguggagcuauaaugcugagcuccuggucgcgcuggaaaaccagcauacaauugaucucaccgacuccgagaugaauaagcuguucgaaaagaccaagaagcagcuucgggagaacgccgaagauauggggaauggaugcuuuaaaaucuaccacaagugugacaacgcuugcaucggcagcauuagaaaugggacauaugaucaugacguguaccgcgacgaggcccugaacaaucgguuccagaucaaaggcguugagcucaagucuggauacaaagauuggauucuguggaucuccuuugccauuagcugcuuccuucuguguguggcucuccugggcuuuaucaugugggccugccaaaaggggaacaucagauguaauauuugcaucuga

SEQ ID NO: 191761 - RNA, 1701 nt, Artificial Sequence; identical to SEQ ID NO: 186637
  derived and/or modified sequence opt5 from hemagglutinin__InfluenzaA__AFH74752

SEQ ID NO: 191762 - RNA, 1701 nt, Artificial Sequence; identical to SEQ ID NO: 186637
  derived and/or modified sequence opt5 from hemagglutinin__InfluenzaA__AFH74763

SEQ ID NO: 191763 - RNA, 1701 nt, Artificial Sequence; identical to SEQ ID NO: 186637
  derived and/or modified sequence opt5 from hemagglutinin__InfluenzaA__AFH74774

SEQ ID NO: 191764 - RNA, 1701 nt, Artificial Sequence; identical to SEQ ID NO: 190012
  derived and/or modified sequence opt5 from hemagglutinin__InfluenzaA__AFH74785

SEQ ID NO: 191765 - RNA, 1701 nt, Artificial Sequence; identical to SEQ ID NO: 186637
  derived and/or modified sequence opt5 from hemagglutinin__InfluenzaA__AFH74796

SEQ ID NO: 191766 - RNA, 1701 nt, Artificial Sequence; identical to SEQ ID NO: 191193
  derived and/or modified sequence opt5 from hemagglutinin__InfluenzaA__AFH74807

SEQ ID NO: 191767 - RNA, 1701 nt, Artificial Sequence; identical to SEQ ID NO: 191193
  derived and/or modified sequence opt5 from hemagglutinin__InfluenzaA__AFH74818

SEQ ID NO: 191768 - RNA, 1701 nt, Artificial Sequence; identical to SEQ ID NO: 191193
  derived and/or modified sequence opt5 from hemagglutinin__InfluenzaA__AFH74829

SEQ ID NO: 191769 - RNA, 1701 nt, Artificial Sequence; identical to SEQ ID NO: 191193
  derived and/or modified sequence opt5 from hemagglutinin__InfluenzaA__AFH74840

SEQ ID NO: 191770 - RNA, 1701 nt, Artificial Sequence
  derived and/or modified sequence opt5 from hemagglutinin__InfluenzaA__AFH74851
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuaugggaauuguuacccuuaugacgugcccgauuacgcuucccuccggucucugguugccagcuccggaacgcuugaguuuaacaaugaaucuuucaacuggaccggcgugacacagaauggcaccucuuccgcuugcauccgcagaagcaagaacagcuuuuucucccggcugaauuggcucacacaucugaacuuuaaauauccugcccuuaaugucaccaugcccaacaacgagcaguucgacaagcuguacauuuggggagugcaccauccugggacggauaaagaccagaucuuucucuaugcgcaagccagcggccgcauuacaguuucuaccaagagaucccagcagacagcuaucccgaauauugggagccggccccgcgugagaaacaucccuucccggaucucuauuuacuggaccaucgucaaacccggagauauucugcugaucaauagcaccggcaaccucauugccccucgcggguacuucaagaucagauccggaaagagcucuaucaugcgguccgacgcucccauuggcaaauguaauagcgagugcaucacaccgaacggcucuauuccuaaugacaagcccuuucagaacgugaaucgcaucacguauggggccuguccuagauacgugaaacaaaacacccugcggcuugcgacaggaaugcgcaauguccccgaaaagcagaccagaggcauuuucggggccaucgcuggauuuaucgagaacggcugggaagggaugguugauggaugguauggcuuccggcaccagaauagcgagggcagagggcaagccgcugaccugaaauccacacaggccgccauugaucagaucaacggaaagcucaaucgccugauuggcaaaaccaacgagaaguuccaccagaucgaaaaggaguuuucugaaguggaggggcggauucaagaccuugaaaaauacguggaggauacgaagaucgaccuguggagcuauaacgcugagcuccuggucgcgcuggaaaaucagcauacaauugaucucaccgacuccgagaugaacaaacuguucgaaaagaccaaaaagcagcuuagagagaaugccgaagauaugggaaacggcugcuuuaagaucuaccacaaaugugacaaugcuugcaucgggagcauucgcaacggcacauaugaucaugacguguaccgggacgaggcccugaauaacagauuccagaucaagggaguugagcucaaaucuggcuacaaggauuggauucuguggaucuccuuugccauuagcugcuuccuucuguguguggcucuccugggguuuaucaugugggccugccaaaaaggaaauauccgcuguaacauuugcaucuga

SEQ ID NO: 191771 - RNA, 1701 nt, Artificial Sequence; identical to SEQ ID NO: 191196
  derived and/or modified sequence opt5 from hemagglutinin__InfluenzaA__AFH74862

SEQ ID NO: 191772 - RNA, 1701 nt, Artificial Sequence; identical to SEQ ID NO: 191196
  derived and/or modified sequence opt5 from hemagglutinin__InfluenzaA__AFH74873

SEQ ID NO: 191773 - RNA, 1701 nt, Artificial Sequence; identical to SEQ ID NO: 186637
  derived and/or modified sequence opt5 from hemagglutinin__InfluenzaA__AFH74884

SEQ ID NO: 191774 - RNA, 1701 nt, Artificial Sequence; identical to SEQ ID NO: 186637
  derived and/or modified sequence opt5 from hemagglutinin__InfluenzaA__AFH74895

SEQ ID NO: 191775 - RNA, 1701 nt, Artificial Sequence; identical to SEQ ID NO: 186637
  derived and/or modified sequence opt5 from hemagglutinin__InfluenzaA__AFH74906

SEQ ID NO: 191776 - RNA, 1701 nt, Artificial Sequence; identical to SEQ ID NO: 186435
  derived and/or modified sequence opt5 from hemagglutinin__InfluenzaA__AFH74917

SEQ ID NO: 191777 - RNA, 1701 nt, Artificial Sequence; identical to SEQ ID NO: 186637
  derived and/or modified sequence opt5 from hemagglutinin__InfluenzaA__AFH74928

SEQ ID NO: 191778 - RNA, 1701 nt, Artificial Sequence; identical to SEQ ID NO: 186637
  derived and/or modified sequence opt5 from hemagglutinin__InfluenzaA__AFH74939

SEQ ID NO: 191779 - RNA, 1701 nt, Artificial Sequence
  derived and/or modified sequence opt5 from hemagglutinin__InfluenzaA__AFH74950
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuaugggaauuguuacccuuaugacgugcccgauuacgcuucccuccggucucugguugccagcuccggaacgcuugaguuuaacaaugaaucuuucaacuggaccggcgugacacagaauggcaccucuuccgcuugcauccgcagaagcaagaacagcuuuuucucccggcugaauuggcucacacaucugaacuuuaaauauccugcccuuaaugucaccaugcccaacaacgagcaguucgacaagcuguacauuuggggagugcaccauccugggacggauaaagaccagaucuuucucuaugcgcaagccagcggccgcauuacaguuucuaccaagagaucccagcagacagcuaucccgaauauugggagccggccccgcgugagaaacaucccuucccggaucucuauuuacuggaccaucgucaaacccggagauauucugcugaucaauagcaccggcaaccucauugccccucgcggguacuucaagaucagauccggaaagagcucuaucaugcgguccgacgcucccauuggcaaauguaauagcgagugcaucacaccgaacggcucuauuccuaaugacaagcccuuucagaacgugaaucgcaucacguauggggccuguccuagauacgugaaacaaaacacccugaaacuugcgacaggaaugcggaauguccccgaaaaacagacccgcggcauuuucggggccaucgcuggauuuaucgagaacggcugggaagggaugguugauggaugguauggcuucagacaccagaauagcgagggccgggggcaagccgcugaccugaaguccacacaggccgccauugaucagaucaacggaaaacucaauagacugauuggcaagaccaacgagaaguuccaccagaucgaaaaagaguuuucugaaguggaggggcgcauucaagaccuugaaaaguacguggaggauacgaaaaucgaccuguggagcuauaacgcugagcuccuggucgcgcuggaaaaucagcauacaauugaucucaccgacuccgagaugaacaagcuguucgaaaagaccaagaagcagcuucgggagaaugccgaagauaugggaaacggcugcuuuaaaaucuaccacaagugugacaaugcuugcaucgggagcauuagaaacggcacauaugaucaugacguguaccgcgacgaggcccugaauaaccgguuccagaucaaaggaguugagcucaagucuggcuacaaagauuggauucuguggaucuccuuugccauuagcugcuuccuucuguguguggcucuccugggguuuaucaugugggccugccaaaagggaaauaucagauguaacauuugcaucuga

SEQ ID NO: 191780 - RNA, 1701 nt, Artificial Sequence; identical to SEQ ID NO: 191196
  derived and/or modified sequence opt5 from hemagglutinin__InfluenzaA__AFH74961

SEQ ID NO: 191781 - RNA, 1701 nt, Artificial Sequence; identical to SEQ ID NO: 186637
  derived and/or modified sequence opt5 from hemagglutinin__InfluenzaA__AFH75388

SEQ ID NO: 191782 - RNA, 1701 nt, Artificial Sequence
  derived and/or modified sequence opt5 from hemagglutinin__InfluenzaA__AFH97140
augaaggccauccuggugguccuccuguacauuuucgcuaccgccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgagcucuuggccuaaucacgauuccaacaagggagugaccgccgcuuguccccaugccggcgcgaaaucuuuuuauaagaaucugauuuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacacugguugaacccggagacaagaucaccuucgaggccacgggcaaccugguggugccucgguacgcguuugccauggaacgcaacgcugggucuggaauuaucaucuccgauacacccguccaugacugcaauaccacaugucaaaccccuaaaggcgccauuaacaccagccuccccuuccagaauauccacccgauuacaaucggcaagugcccuaaguaugugaaaucuacgaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 191783 - RNA, 1701 nt, Artificial Sequence
  derived and/or modified sequence opt5 from hemagglutinin__InfluenzaA__AFJ05142
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagugcuucaacuggaccggagugacacagaauggcaccucuuccgcuuguauucgcagaagcaacucuuccuuuuucagccggcuuaauuggcugacacaucucaacuuuaaguauccugcccugaaugucaccaugcccaacaacgagcaguucgacaaacuuuacaucuggggcgugcaccauccugggacggauaaagaccagauuuuucuguaugcgcaaucuuccggacgcaucacaguuagcaccaagagaucccagcaggccgugauuccgaauaucggcucucggccccgcaucagaaacauuccuagccggaucuccauuuacuggacaaucgucaaacccggggauauucuccugaucaauagcaccggaaaccugaucgcuccucgcggcuacuucaagauuagaucugggaaauccagcaucaugcggucugacgcccccauuggaaagugcaauagcggcuguaucaccccgaacggcuccauuccuaaugacaagcccuuucagaacgugaaucgcaucacauauggggcuugcccuagauacgugaaacaaucuacgcucaagcuggccaccggaaugcggaacguccccgaaaaacagacacgcggcaucuucggggcgauugccggauuuaucgagaauggcugggaagggaugguugauggaugguauggcuucagacaccagaacagcgagggccgggggcaagcugccgaccuuaaguccacccaggcugccauugaucagaucaauggaaaacugaacagacucauuggcaagacaaaugagaaauuccaccagaucgaaaaggaguuuagcgaaguggaggggcgcauucaagaccuggaaaaguacguggaggauaccaaaaucgaccuuuggucuuauaacgccgagcugcucgucgcucuggaaaaccagcauacgaucgaucugacagacuccgagaugaauaaacucuucgaaaagaccaagaagcagcugcgggagaacgcggaagauaugggaaauggcuguuuuaagauuuaccacaagugcgacaacgccugcaucgggagcauuagaaauggcaccuauaaccaugauguguaccgcgacgaggcucuuaauaaccgguuccagaucaaaggaguugagcugaagucuggcuacaaagacuggauucucuggaucuccuuugccaucagcuguuuccugcuuugcguggcccugcucggguuuauuaugugggcuugucaaaagggaaauaucagaugcaacauuuguaucuga

SEQ ID NO: 191784 - RNA, 1701 nt, Artificial Sequence
  derived and/or modified sequence opt5 from hemagglutinin__InfluenzaA__AFJ05144
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcgucagaaacaucccuucccggaucagcauuuacuggacaaucgugaaacccggggauauucugcugaucaauucuaccggaaaccucauugcuccucgcggcuacuucaagaucagauccgggaaaagcucuaucaugcggagcgacgcccccauuggaaaguguaauuccgaaugcaucaccccgaacggcucuauuccuaaugacaagcccuuucagaacgugaaucgcaucacauauggcgcuuguccuagauacgucaaacaaagcacgcugaagcuggccaccgggaugcggaacguucccgagaaacagacacgcggaauuuucggcgcgaucgccggguuuaucgaaaauggaugggagggcaugguggaugggugguauggauucagacaccagaacuccgagggccggggccaagcugccgaccuuaagagcacccaggcugccauugaucagaucaaugggaaacucaacagacugauuggaaagacaaaugaaaaauuccaccagaucgagaaggaauuuucugagguggaaggccgcauucaagaccuugagaaguacgucgaggauaccaaaaucgaccugugguccuauaacgccgaacuccugguggcucuggagaaccagcauacgauugaucucacagacagcgaaaugaauaagcuguucgagaaaaccaagaaacagcuucgggaaaacgcggaggauauggggaauggaugcuuuaagaucuaccacaagugugacaacgccugcaucggcucuauuagaaaugggaccuauaaccaugauguuuaccgcgacgaggcucugaauaaccgguuccagaucaaaggcguggaacucaaguccggauacaaagacuggauucuguggaucagcuuugccauuuccugcuuccuucugugugucgcccuccugggcuuuaucaugugggcuugccaaaaggggaauaucagauguaacauuugcaucuga

SEQ ID NO: 191785 - RNA, 1701 nt, Artificial Sequence
  derived and/or modified sequence opt5 from hemagglutinin__InfluenzaA__AFJ11706
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaucagaucuuccaacaauagcuuuuucucuagacugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccuccggacggauuacaguuagcaccaagcgcucccagcaggcugugaucccgaacauuggcucuagaccccggguccgcaauaucccuagcagaaucuccauuuacuggacaaucgugaaacccggggauauucugcugaucaacagcaccggaaaucucauugccccucggggcuacuucaagauccgcucugggaaauccagcaucaugagaucugacgcucccauuggaaaguguaacagcgaaugcaucaccccgaauggcuccauuccuaacgacaagcccuuucagaaugugaaccggaucacauauggcgccuguccucgcuacgucaaacaaucuacgcugaaacuugcgaccgggaugagaaauguucccgagaagcagacacggggaauuuucggcgccaucgcuggguuuaucgaaaacggaugggagggcaugguggaugggugguauggauuccgccaccagaauagcgagggcagaggccaagccgcugaccugaaguccacccaggccgccauugaucagaucaacgggaaacucaaucggcugauuggaaagacaaacgaaaaauuccaccagaucgagaaggaauuuagcgagguggaaggccgcauucaagaccuugagaaguacgucgaggauaccaaaaucgaccuguggucuuauaacgcugaacuccugguggcgcuggagaaucagcauacgauugaucucacagacuccgaaaugaacaagcuguucgagaaaaccaagaaacagcuucgcgaaaaugccgaggauauggggaacggaugcuuuaccaucuaccacaagugugacaaugcuugcaucggcagcauucggaacgggacauaugaucauaauguuuacagagacgaggcccugaacaaucgcuuccagaucaagggcguggaacucaaaucuggauacaaggacuggauucuguggaucuccuuugccauuagcugcuuccuucugugugucgcucuccugggcuuuaucaugugggccugccaaaaagggaacauccgguguaauauuugcaucuga

SEQ ID NO: 191786 - RNA, 1701 nt, Artificial Sequence; identical to SEQ ID NO: 190006
  derived and/or modified sequence opt5 from hemagglutinin__InfluenzaA__AFJ11728

SEQ ID NO: 191787 - RNA, 1701 nt, Artificial Sequence
  derived and/or modified sequence opt5 from hemagglutinin__InfluenzaA__AFJ19842
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgcccuggagaaucaacacaccauugaucucacggacucugaaaugaacaaacuguucgagaagaccaaaaagcagcuuagagaaaaugcugaggauauggggaacggaugcuuuaaaaucuaccauaagugugacaaugccugcaucggcuccauucgcaacgggacauaugaucacgacguguaccgggacgaggcccugaauaacagauuccagaucaagggcauugaacucaaaagcggauacaaggauuggauccuguggauuucuuuugcuaucuccugcuuccuucuguguguugcccuccugggcuuuaucaugugggcgugccagaaagggaauauucgcuguaacaucugcauuuga

SEQ ID NO: 191788 - RNA, 1701 nt, Artificial Sequence; identical to SEQ ID NO: 191385
  derived and/or modified sequence opt5 from hemagglutinin__InfluenzaA__AFJ20171

SEQ ID NO: 191789 - RNA, 1701 nt, Artificial Sequence; identical to SEQ ID NO: 190006
  derived and/or modified sequence opt5 from hemagglutinin__InfluenzaA__AFJ20182

SEQ ID NO: 191790 - RNA, 1701 nt, Artificial Sequence
  derived and/or modified sequence opt5 from hemagglutinin__InfluenzaA__AFJ74386
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccaaucugucuaaguccuacgugaacaauaaagagaaggaaguucucgugcuguggggaguccaucacccuagcaacauuggggaucagagagccaucuaccacaccgagaacgcguauguguccgugaugucuagccauuacucccggcgcuuuacgccggaaaucgccaagagacccaaaguccgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgagugugacgccaagugccagaccccucaaggcgcuauuaauucuagccugcccuuucagaacguucacccggugaccaucggggaauguccuaaauacgugcgguccacaaagcuccgcauggucacgggacugagaaauauccccucuauucagagccggggccuuuucggggccaucgcuggauuuauugagggcggguggaccggaaugaucgauggcugguauggcuaccaucaccagaacgaacaaggguccggauacgccgccgaccagaaaagcacacagaaugcuauugauggcaucaccaacaagguuaauucugugaucgagaaaaugaacacacaguucaccgcgguggggaaggaguucaauaagcuggaacgcagaauggagaaccucaauaaaaaggucgacgauggauuucuggacauuuggacguauaacgccgaacugcucgugcugcuugagaacgaacggacacuggacuuccacgauuccaauguuaaaaaccucuacgagaaggugaaaaaucaacugaagaacaaugcuaaggagaucggcaacgggugcuuugaguucuaucauaaauguaauaacgaaugcauggaaagcgucaagaauggcaccuacgacuauccuaaauacucuggagaguccaaacuuaaccgcgagaaaauugauggcgugaagcuggaaagcaugggggucuaucagauccucgccauuuacuccaccguggccucuagccugguucugcucgugucccugggagcuaucucuuuuuggaugugcagcaauggcucccuucaguguagaaucugcauuuga

SEQ ID NO: 191791 - RNA, 1701 nt, Artificial Sequence
  derived and/or modified sequence opt5 from hemagglutinin__InfluenzaA__AFJ74407
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaguuagcucccggaucagcauuuauuggaccaucgugaagccuggcgacauucugcucaucaauucuaccgggaaccugaucgcuccccgcggauacuucaagauuagauccggcaaaagcucuaucaugcggagcgaugccccuauuggcaacuguuccucugagugcaucacacccaaugggagcauuccgaacgacaagccuuuucaaaaugugaaccgcaucacguauggagcuugucccagauacgucaaacagaauacccuuaagcuggccacaggcaugcggaacgugccugaaaaacagacccgcgggaucuucggagcgauugccggcuuuaucgagaaugggugggaaggaaugguugauggcugguauggcuucagacaccagaacuccgaggggacaggacaagcugccgaccucaagagcacccaggcugccauuaaucagaucaacggcaaacugaaucggcuuauugagaagacgaacgaaaaguuucaucaaaucgagaaagaguucucugaaguggaagggagaauccaggaucuggagaaguacgucgaggacacaaaaauugaucucugguccuauaaugccgaacugcugguggcucucgagaaccagcacaccaucgaccugaccgauagcgaaaugaauaaacuuuucgagcgcacacggaagcagcugagagaaaacgcggaggacaugggaaacggcugcuuuaagauuuaccauaagugugauaaugccugcaucgggucuauucgcaacggcaccuacgaccacgacguuuaucgggaugaggcucucaauaacagauuccaaaucaaaggaguggaacugaaguccggcuacaaagacuggauucuuuggaucagcuuugccaucuccugcuuccugcucugugucgugcugcugggguuuauuaugugggccugccagaagggaaauauccgcuguaacauuugcaucuga

SEQ ID NO: 191792 - RNA, 1701 nt, Artificial Sequence
  derived and/or modified sequence opt5 from hemagglutinin__InfluenzaA__AFJ74418
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuauuaaguccuuuuucagccgccucaacuggcugcaccagcuuaaguauaaauacccugcgcugaaugucaccaugcccaacaaugagaaguuugacaaacucuauaucuggggcgugcaucacccuucuacagauuccgaccagauuagccuguacgcccaggcuuccgggagaguuaccgugucuacgaagcggagccaacagacagucaucccgaacauuggaucccgccccugggugagaggcgugagcucucggaucuccauuuacuggaccaucgucaaaccuggggauauccugcucauuaacagcacaggaaaucugaucgcuccccgcggcuauuucaagauuagaucuggaaagagcuccaucaugcggucugacgccccuauugggaaauguaacagcgaaugcaucacccccaauggcuccaucccgaacgacaagccuuuucagaauguuaaccgcauuaccuacggcgccugucccagauaugugaaacagaauacacuuaagcuggcgacggggaugcggaacgugccugagaaacaaacccgcggaaucuucggcgccauugcuggguuuaucgaaaauggaugggagggcauggucgaugggugguacggauucagacaccagaacagcgagggcacaggccaggccgcugaccucaagucuacccaagccgccauuaaucagaucaacgggaaacugaaucggcuuaucgaaaagacaaacgagaaguuucaucagauugaaaaagaguucuccgaaguggagggaagaauccaggaucuggagaaguauguugaagacaccaaaauugaucucuggagcuacaaugcugagcugcugguggcgcucgaaaaccaacacacgaucgaccugacagauucugagaugaacaaacuuuucgaacgcaccaagaagcagcugcgggagaaugccgaggacaugggcaacgggugcuuuaagauuuaucauaaaugugauaaugcuugcaucggauccauuagaaacggcaccuacgaccacgaugucuaccgcgacgaagcccucaauaaccgguuccagaucaaggggguggagcugaaaagcggcuauaaggacuggauccuuuggauuuccuuugccaucucuugcuuccugcucuguguugugcugcugggauuuauuaugugggcuugccagaaaggcaauaucagauguaacauuugcaucuga

SEQ ID NO: 191793 - RNA, 1701 nt, Artificial Sequence
  derived and/or modified sequence opt5 from hemagglutinin__InfluenzaA__AFJ74437
augaagaccaucauugcccugagcuacauccucugcaaaguguucgcucagaagcugcccggcaacgacaauuccacagccacgcuuugucuggggcaccaugcggucccuaacggaacccucguuaaaacaauuaccaaugaucaaaucgaggugacaaacgcuaccgaacuggugcagucuagcuccacaggcagaauuugcgacucuccgcaccagauccuugauggggagaauuguacccugaucgacgcccuccugggagauccccauugcgacggcuuucagaacaaggaaugggaucuguucgucgagcggagcaaagccuauuccaauuguuacccuuaugacgugcccgauuacgcuucucuccgcagccugguugccuccagcgggacgcuugaauuuaacaaugagucuuucaacuggaccggaguggcucaaaauggcacauccagcgccugcaagagacggucuauuaaguccuuuuucagccgccugaacuggcuccaccagcugaaauauaaguacccugcgcuuaaugucaccaugcccaacaaugagaaauuugacaagcuguauaucuggggcgugcaucacccuucuacagauuccgaccagauuagccucuacgcccaggcuuccgggagaguuaccgugucuacgaaacggagccaacagacagucaucccgaacauuggaucccgccccugggugagaggcgugagcucucggaucuccauuuacuggaccaucgucaagccuggggauauccugcugauuaacagcacaggaaaucucaucgcuccccgcggcuauuucaagauuagaucugggaaaagcuccaucaugcggucugacgccccuauuggaaaguguaacagcgaaugcaucacccccaauggcuccaucccgaacgacaaaccuuuucagaauguuaaccgcauuaccuacggcgccugucccagauaugugaagcagaauacacugaaacuugcgacggggaugcggaacgugccugagaagcaaacccgcggaaucuucggcgccauugcuggguuuaucgaaaauggaugggagggcauggucgaugggugguacggauucagacaccagaacagcgagggcacaggccaggccgcugaccugaaaucuacccaagccgccauuaaucagaucaacgggaagcucaaucggcugaucgaaaagacaaacgagaaauuucaucagauugaaaaggaguucuccgaaguggagggaagaauccaggaucuugagaaauauguugaagacaccaagauugaucuguggagcuacaaugcugagcuccugguggcgcuggaaaaccaacacacgaucgaccucacagauucugagaugaacaaacuguucgaacgcaccaagaagcagcuucgggagaaugccgaggacaugggcaacgggugcuuuaaaauuuaucauaagugugauaaugcuugcaucggauccauuagaaacggcaccuacgaccacgaugucuaccgcgacgaagcccugaauaaccgguuccagaucaaagggguggagcucaagagcggcuauaaagacuggauccuguggauuuccuuugccaucucuugcuuccuucuguguguugugcuccugggauuuauuaugugggcuugccagaagggcaauaucagauguaacauuugcaucuga

SEQ ID NO: 191794 - RNA, 1701 nt, Artificial Sequence
  derived and/or modified sequence opt5 from hemagglutinin__InfluenzaA__AFJ74448
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggaggcccccauugcgauggguuucagaacaaagaaugggaccucuucgucgagcggagcaaggccuauuccaauuguuacccuuaugaugugcccgacuacgcuucucugcgcagccuuguugccuccagcggaacgcuggaauuuaacaaugagucuuucaacuggaccggcguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugauaaacucuauauuuggggagugcaucacccuucuacagacuccgaucagaucagccuguacgcccaggcuuccgggagaguuaccgugucuacgaagcggagccaacagacagucauuccgaacaucggcucccgccccugggugagaggggugagcucucggauuuccaucuacuggaccauugucaaaccuggagacauccugcucaucaauagcacaggcaaccugauugcccccagaggguauuucaagaucagaucuggaaagagcuccauuaugcggucugaugcuccuaucggcaaauguaauagcgaaugcauuacccccaacggcuccaucccgaaugacaagccuuuucagaacguuaaucgcaucaccuacggggccugucccagauaugugaaacagaacacacuuaagcuggcgacgggaaugcggaaugugccugagaaacaaacccgcggcauuuucggggccaucgcuggauuuauugaaaacggcugggaggggauggucgacggaugguacggcuucagacaccagaauagcgagggcacagggcaggccgcugaucucaagucuacccaagccgccaucaaccagauuaauggaaaacugaaccggcuuaucgaaaagacaaaugagaaguuucaucagaucgaaaaagaguucuccgaaguggagggccgcauucaggaccuggagaaguauguugaagauaccaaaaucgaccucuggagcuacaacgcugagcugcugguggcgcucgaaaaccaacacacgauugaucugacagacucugagaugaauaaacuuuucgaacgcaccaagaagcagcugcgggagaacgccgaggauauggggaauggaugcuuuaagaucuaucauaaaugugacaacgcuugcauuggcuccaucagaaaugggaccuacgaucacgacgucuaccgcgaugaagcccucaacaaucgguuccagauuaagggcguggagcugaaaagcggauauaaggacuggauccuuuggaucuccuuugccauuucuugcuuccugcucuguguugugcugcugggcuuuaucaugugggcuugccagaaagggaacauuagauguaauaucugcauuuga

SEQ ID NO: 191795 - RNA, 1701 nt, Artificial Sequence
  derived and/or modified sequence opt5 from hemagglutinin__InfluenzaA__AFJ74459
auggaggccaagcugcucgugcugcuuugcgcuuucaccgccacauacgcggacacgaucuguauuggcuaucacgcuaacaauagcaccgauacagucgacaccguucuggaaaagaacgugacagugacccauuccgucaaucuccuggaggauucucacaacgggaaacuuugcagacugaaaggaacagcuccccuccagcugggcaauuguagcaucgccggguggauucugggaaacccugaaugcgagucccucuuuucuaaggaaagcugguccuacaucgccgagaccccgaaucccgagaacggcacguguuauccuggguacuucgccgacuaugaggaacugcgggaacaacuuucuagcguguccagcuuugagcgcuucgagauuuuucccaaagaaucuuccuggccuaaucauaccguuacaaagggagugaccgcuagcugcucucacaacggcaaguccagcuucuacaaaaaucugcucuggcugacagagaagaacggccuuuaucccaaucugucuaaauccuacgucaacaauaaggaaaaagaggugcucguucuguggggagugcaucacccuagcaacaucggggaucagagagccaucuaccacaccgaaaacgcguaugucuccguggugucuagccauuacucccggcgcuuuacgccggagauugccaagagacccaagguccggaaucaggagggccgcaucaacuauuacuggacacugcucgaaccuggggacaccauuaucuucgaggcuaauggaaaccugauugcccccugguaugcuuuugcccuuagcagaggcuucgggucuggaaucauuacauccaaugcgagcaugggcgaaugugaugccaaaugccagaccccucaaggcgcuaucaacucuagccugcccuuucagaauguucacccggugaccaucggggaguguccuaaguacgugcgguccacaaaacuccgcauggucacgggacugagaaacauucccucuauccagagccggggccuuuucggggccauugcuggauuuaucgaaggcggguggaccggaaugauugacggcugguauggcuaccaucaccagaaugagcaaggguccggauacgccgccgaucaaaagagcacacagaacgcuaucaauggcaucaccaacaaaguuaauucuauuaucgagaagaugaacacacaguucaccgcgguggggaaagaguucaauaagcuggaacgcagaauggaaaaccucaacaagaaaguggacgauggauuucuggacauuuggacguauaaugccgagcugcucguccugcuugaaaacgagcggacacuggauuuccacgacuccaaugugaagaaccucuacgagaaaguuaagaaucagcugaaaaacaaugcuaaggaaaucggcaacgggugcuuugaguucuaucauaaguguaauaacgaaugcauggagagcgugaaaaauggcaccuacgacuauccuaaguacucuaaagaguccaaacuuaaccgcgaaaagauugauggagucaagcuggagagcaugggcguguaucagauccucgccaucuacuccaccgucgccucuagccuggugcugcucguuucccugggggcuauuucuuuuuggaugugcagcaauggaucccuucaguguagaaucugcauuuga

SEQ ID NO: 191796 - RNA, 1701 nt, Artificial Sequence
  derived and/or modified sequence opt5 from hemagglutinin__InfluenzaA__AFJ74470
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaagucuuucuucuccagacucaacuggcugcacaaacuugaguacaaguauccugcgcugaaugugaccaugcccaacaaugacaaauuugauaagcucuacauuuggggcguucaucacccuagcacagacucugaucaaaucucccuguacgcccagaccagcgggcgggugacggucuccacaaaacgcucucagcagaccgugauuccgaacaucggaagcagacccugggugcggggcgucuccagccgcauuucuaucuauuggacaauuguuaagccuggggacauccugcucaucaacuccaccggaaaucugauugcucccagaggcuacuucaagauccggagcgggaaaucuagcauuaugcgcuccgacgccccuaucggaaacuguucuagcgagugcauuacccccaauggcuccaucccgaacgauaagccuuuucaaaaugugaacagaaucacauauggcgcuuguccccgguacgugaaacagaauacgcuuaagcuggccaccgggaugcgcaacgucccugaaaaacagacaagaggaauuuucggcgcgaucgccggguuuauugagaauggaugggaaggcaugguggacgggugguauggauuccggcaccagaacagcgagggcaccggccaagcugccgaucucaagucuacacaggcugccaucaaucagauuaacgggaaacugaauagacuuaucgagaagaccaacgaaaaguuucaucaaaucgagaaagaauuuuccgagguugaaggacgcauucaggaccuggagaaguacguggaggauacgaaaaucgaccucuggagcuauaaugccgaacugcuggucgcucucgagaaccagcacacaauugaucugaccgacucugaaaugaacaagcuguucgagcggaccagaaaacagcugcgcgaaaaugcggaggauaugggcaacgggugcuuuaagaucuaccauaagugugacaaugccugcauuggauccauccggaacggcacauacaaucacgauguguauagagacgaggcucucaacaaucgcuuccaaauuaaagggguugaacuuaagagcggcuacaaagacuggauccuuuggaucuccuuugccauuucuugcuuccugcucugugugguccugcugggauuuaucaugugggccugccagaagggcaacauucgguguaauaucugcauuuga

SEQ ID NO: 191797 - RNA, 1701 nt, Artificial Sequence
  derived and/or modified sequence opt5 from hemagglutinin__InfluenzaA__AFJ74492
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacaagaaauuugacaagcucuauauuuggggcgugcaucacccuucuacagauuccgaccagaucagccuguacgcccaggcuuccgggagaguuaccgugucuacgaaacggagccaacagacagucauuccgaacaucggaucccgccccugggugagaggcgugagcucuauuaucuccauuuacuggaccaucgucaagccuggggauauccugcucauuaauagcacaggaaaccugaucgcuccccggggcuauuucaagauucgcaaugggaaaucuagcaucaugagauccgacgccccuauuggaaaguguaacucugagugcaucacccccaauggcagcaucccgaacgacaaaccuuuucagaauguuaaccggauuaccuacggcgccuguccccgcuaugugaagcagaauacacuuaaacuggcgacggggaugagaaacgugccugaaaagcaaacccggggaaucuucggcgccauugcuggguuuaucgagaauggaugggaaggcauggucgaugggugguacggauuccgccaccagaacuccgagggcacaggccaggccgcugaccucaaaagcacccaagccgccauuaaucagaucaacgggaagcugaauagacuuaucggaaagacaaacgagaaauuucaucagauugaaaaggaguucucugaaguggagggccggauccaggaucuggaaaaauauguugaggacaccaagauugaucucugguccuacaacgcugagcugcugguggcgcucgaaaaucaacacacgaucgaccugacagauagcgagaugaacaaacuuuucgaaagaaccaagaagcagcugcgcgagaaugccgaagacauggggaacggaugcuuuaaaauuuaucauaagugugauaaugcuugcaucggcucuauucggaacgggaccuacgaccacgaugucuacagagacgaggcccucaauaaccgcuucaaaaucaagggcguggagcugaaauccggauauaaggacuggauccuuuggauuagcuuugccaucuccugcuuccugcucuguguugugcugcugggcuuuauuaugugggcuugccagaaggggaauauccgguguaacauuugcaucuga

SEQ ID NO: 191798 - RNA, 1701 nt, Artificial Sequence
  derived and/or modified sequence opt5 from hemagglutinin__InfluenzaA__AFJ74525
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucaggacggcacauccagcgccugcaaacggcgcucuauuaaguccuuuuucagcagacucaauuggcugcaccaacuuaaguauaaauacccugcgcugaacgucaccaugcccaauaacgauaaguuugacaaacucuauaucuggggcgugcaucacccuucuacagauuccgaccagaccagccuguacgcccaggcuuccgggcggguuacggugucuacaaagcgcagccagcaaaccgucauuccgaauaucggauccagacccugggugcggggcgugagcucuauuaucuccauuuacuggacaaucgucaaaccuggggacauccugcucauuaacagcaccggaaaccugaucgcuccccgcggcuauuucaagauuagaucuggaaagagcuccaucaugcggucugaugccccuauugggaaauguaauagcgagugcaucacccccaacggcuccaucccgaaugacaagccuuuucagaacguuaaucgcauuacauacggcacgugucccagauaugugaaacagaacacccuuaagcuggccacagggaugcggaaugugccugaaaaacagacccgcggaaucuucggcgcgauugccggguuuaucgagaacggaugggaaggcauggucgaugggugguacggauucagacaccaaaauagcgagggcacaggccaggcugccgaccucaagucuacccaggcugccauuaaccaaaucaaugggaaacugaaccggcuuaucgagaagacgaaugaaaaguuucaucagauugagaaagaguucuccgaaguggaaggaagaauccaggaucuggagaaguauguugaggacacaaaaauugaucucuggagcuacaacgccgaacugcugguggcucucgagaaucagcacaccaucgaccugaccgauucugaaaugaacaagcuguucgagcgcacacggaaacaacugagagaaaacgcggaggacaugggcaaugggugcuuuaagauuuaucauaagugugauaacgccugcaucggauccauucgcaauggcaccuacgaccacgacgucuaccgggaugaggcucucaacaauagauuccagaucaaagggguggaacuuaagagcggcuauaaagacuggauccuuuggauuuccuuugccaucucuugcuuccugcucuguguugugcugcugggauuuauuaugugggccugccagaagggcaacauccgcuguaauauuugcaucuga

SEQ ID NO: 191799 - RNA, 1701 nt, Artificial Sequence; identical to SEQ ID NO: 191797
  derived and/or modified sequence opt5 from hemagglutinin__InfluenzaA__AFJ74535

SEQ ID NO: 191800 - RNA, 1701 nt, Artificial Sequence
  derived and/or modified sequence opt5 from hemagglutinin__InfluenzaA__AFJ74560
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcagaccagcggaagagugacggucuccacaaagcggucucaacagaccgugauuccgaacaucggcagcgggcccugggugcgcggagucuccagcagaauuucuaucuacuggacaauuguuaaaccuggcgacauccugcucaucaacuccaccgggaaucugauugcuccccggggauauuucaagauccgcagcggcaagucuagcauuaugagauccgacgccccuaucggcaaauguaacucugaaugcauuacccccaaugggagcaucccgaacgauaagccuuuucagaaugugaaccggaucacauacggacccuguccucgcuaugugaaacagaauacgcuuaagcuggccaccggcaugagaaacguccccgagaaacaaacacgggggauuuucggagcuaucgccggcuuuauugaaaaugggugggagggaaugauggacggcugguacggcuuccgccaccagaacuccgaggggaccggacaggcggccgaucucaagagcacacaagcugccaucaaucagauuaacggcaaacugaauagacuuguggaaaagaccaacgagaaguuucaucagaucgaaaaagaguucucugaaguugaggggcggauccaggaccuggagaaguauguggaagauacgaaaauugaccucugguccuacaaugcugagcugcuggucgcccucgaaaaccaacacacaaucgaucugaccgacagcgagaugaacaaacuuuucgaaagaaccaagaagcagcugcgcgagaaugccgaggauaugggaaacggcugcuuuaagauuuaucauaaaugugacaaugcuugcaucgggucuauucggaacggcacauacgaucacgacguguacagagacgaagcgcucaauaaccgcuuccagaucaagggaguugagcugaaauccggcuauaaggauuggauucuuuggaucagcuuugccaucuccugcuuccugcucuguauugugcugcugggguuuaucaugugggcuugccagaaaggaaauauucgguguaacaucugcauuuga

SEQ ID NO: 191801 - RNA, 1701 nt, Artificial Sequence
  derived and/or modified sequence opt5 from hemagglutinin__InfluenzaA__AFJ74634
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacagcugaaauauaaguacccugcccuuaacgucaccaugcccaauaacgagaaauuugacaagcuguauaucuggggagugcaucacccugggacggauucugaccagauuucccucuacgcgcaagccagcggccgcaucacaguuuccaccaaaagaucucagcagacagugauuccgaacaucgggagccggccccgcgucagagauguguccagccggauuucuaucuacuggaccaucgugaagccuggagacauucugcugaucaauuccaccggcaaccucauugcuccccgcggguauuucaagaucagaagcggaaaaucuagcauuaugcgguccgacgccccuaucggcaaguguaauucugagugcaucacacccaacggcagcauuccgaaugauaaaccuuuucagaacgucaaucgcaucacguacggggcuugucccagauauguuaagcaaaacacccugaaacuugccacaggaaugcggaaugugccugaaaagcagacccgcggcauuuucggggcgaucgccggauuuauugagaacggcugggaagggaugguggacggaugguacggcuucagacaucaaaauuccgagggcacagggcaggcugccgaucugaaaagcacccaggcugccaucaaccagaucaauggaaagcucaaccggcugauuggcaagacgaaugagaaauuucaccagaucgaaaaggaguucucugaagucgaggggcgcauucaagaccuugaaaaauauguggaggauacaaagaucgaccugugguccuacaacgccgagcuccugguugcucuggaaaaccagcacaccauugaucucaccgacagcgagaugaauaaacuguucgaaagaacaaagaagcagcuucgggagaacgcggaagauaugggaaauggcugcuuuaaaaucuaucauaagugugacaacgccugcauugggucuaucagaaauggcaccuacgaucacgacguguaccgcgacgaggcucugaacaaucgguuccagaucaaaggagucgagcucaaguccggcuauaaagauuggauucuguggaucagcuuugccauuuccugcuuccuucuguguguggcccuccugggguuuaucaugugggcuugccaaaagggaaacauuagauguaauaucugcaucuga

SEQ ID NO: 191802 - RNA, 1698 nt, Artificial Sequence
  derived and/or modified sequence opt5 from hemagglutinin__InfluenzaA__AFJ74653
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccuggguacuuugccgacuaugaggaacugagagagcaacucuccucugucagcuccuucgaacgguuugagaucuuccccaaggagagcucuuggccuaaucauacggugaccggaguuuccgccagcugcucucacaacggcaaauccagcuuuuacaagaaucugcuuuggcugacaggcaaaaacgggcucuaucccaaucugucuaaguccuacgcuaacaauaaagaaaaggaggugcugguccucuggggagugcaucacccuccgaacaucggcgaucagcgcgcccuguaccacaccgacaacgcuuaugugagcgucguuuccucucauuacagcagaaaguucacacccgaaauugccaaacggccuaaggugcgcgaucaggaggggagaaucaauuauuacuggacccuucuggaacccggagacacgauuaucuuugaggcgaacggcaaucucauugccccucgguaugcuuucgcccugucccgcggguuuggaagcggcaucauuaacucuaaugcucccauggaugagugugacgccaaaugccagacaccgcaaggcgcgaucaacuccagccuuccuuuccagaaugugcaccccgucaccaucggggaauguccuaaguacgugagaucugccaaacugcggaugguuacaggacuccgcaacauucccagcauccaguccagaggccuguuuggggcuauugccggauucaucgagggcggguggaccggaaugguggauggcugguauggcuaccaucaccagaaugaacaagggucuggauacgcugccgaccaaaagagcacccagaacgccauuaauggcaucacaaacaaagucaauuccgugaucgagaagaugaacacgcaguuuaccgcuguugggaaggaguucaauaaacuggaacggcgcauggagaaccucaacaagaaaguggaugacggauucauugacaucuggacauauaaugcggaacugcuuguccugcucgagaacgaaagaacccuggauuuucacgacagcaaugugaagaaccuuuacgagaaagucaagucucagcugaagaauaacgccaaagaaauuggcaaugggugcuucgaguuuuaucauaaguguaacgaugagugcauggaauccgugaaaaauggcacauacgacuaucccaaguacagcgaggaaucuaaacucaaccgggagaagaucgauggaguuaagcuggaguccaugggcguguaucagauucuggcuaucuacagcaccgucgccuccucucucgugcugcuuguuagccugggggccaucuccuucuggaugugcucuaauggaagccuccagugucgcauuugcaucuga

SEQ ID NO: 191803 - RNA, 1698 nt, Artificial Sequence
  derived and/or modified sequence opt5 from hemagglutinin__InfluenzaA__AFJ74673
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccuggguacuuugccgacuaugaggaacugagagagcaacucuccucugucagcuccuucgaacgguuugagaucuuccccaaggagagcucuuggccuaaucauacggugaccggaguuuccgccagcugcucucacaacggcaaauccagcuuuuacaagaaucugcuuuggcugacaggcaaaaacgggcucuaucccaaucugcgcaagucuuacgcuaacaauaaagaaaaggaggugcugguccucuggggagugcaucacccuccgaacaucggcgaucagagagcccuguaccacaccgacaacgcuuauguguccgucguuagcucccauuacucucggaaguucacacccgaaauugccaaacgcccuaaggugagagaucaggaggggcggaucaauuauuacuggacccuucuggaacccggagacacgauuaucuuugaggcgaacggcaaucucauugccccucgcuaugcuuucgcccugagcagaggguuuggauccggcaucauuaacagcaaugcucccauggaugagugugacgccaaaugccagacaccgcaaggcgcgaucaacucuucccuuccuuuccagaaugugcaccccgucaccaucggggaauguccuaaguacgugcggagcgccaaacugcgcaugguuacaggacucagaaacauucccucuauccagagccggggccuguuuggggcuauugccggauucaucgagggcggguggaccggaaugguggauggcugguauggcuaccaucaccagaaugaacaaggguccggauacgcugccgaccagaagucuacccagaacgccauuaauggcaucacaaacaaagucaauagcgugaucgagaagaugaacacgcaguuuaccgcuguugggaaggaguucaauaaacuggaacgcagaauggagaaccucaacaagaaaguggaugacggauucauugacaucuggacauauaaugcggaacugcuuguccugcucgagaacgaacggacccuggauuuucacgacuccaaugugaagaaccuuuacgagaaagucaagagccaacugaagaauaacgccaaagaaauuggcaaugggugcuucgaguuuuaucauaaguguaacgaugagugcauggaaucugugaaaaauggcacauacgacuaucccaaguacuccgaggaaagcaaacucaaccgcgagaagaucgauggaguuaagcuggagucuaugggcguguaucagauucuggcuaucuacuccaccgucgccagcucccucgugcugcuuguuucucugggggccaucagcuucuggaugugcuccaauggaucucuccaguguagaauuugcaucuga

SEQ ID NO: 191804 - RNA, 1701 nt, Artificial Sequence
  derived and/or modified sequence opt5 from hemagglutinin__InfluenzaA__AFJ74674
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaaaagugggaucucuucgucgaaagaagcaaagccuauuccaauuguuacccuuaugacgugcccgauuacgcuucucugcggagccuuguugccuccagcggaacgcuggaguuuaacaaugaaucuuucaacuggaccggcguggcucaaaauggcacauccagcgccugcaagcgcagaucuaacaaguccuuuuucagccggcucaauuggcugcaccagcuuaaauauaaguacccugcgcugaacgucaccaugcccaauaacgagaaauuugacaagcucuauauuuggggagugcaucacccugggacagauucugaccagaucucccuguacgcccaggcuagcggccgcauuaccguuuccacgaaaagaucucaacagacagugaucccgaacauugggagccggccccgcgucagagauguguccagccggaucucuauuuacuggaccaucgugaagccuggagacauccugcucauuaauuccacaggcaaccugaucgcuccccgcggguauuucaagauuagaagcggacggucuagcaucaugcgcuccgacgccccuauuggcaaauguaauucugagugcaucacccccaacggcagcaucccgaaugauaagccuuuucagaacgucaauagaauuaccuacggggccuguccccgguauguuaaacagaacacacuuaagcuggcgacgggaaugcgcaaugugccugaaaaacaacccagaggcaucuucggggccauugcuggauuuaucgagaacggcugggaagggaugguggacggaugguacggcuuccggcaccaaaauuccgagggcaccgggcaggccgcugaucucaagagcacacaggccgccauuaaccagaucaauggaaaacugaacagacuuaucggcaagaccaaugagaaguuucaucagauugaaaaagaguucucugaagucgaggggcgcauccaggaccuggaaaaguauguggaggauacaaaaauugaccucugguccuacaacgcugagcugcugguugcgcucgaaaaccaacacaccaucgaucugacggacagcgagaugaauaaacuuuucgaacggacaaagaagcagcugagagagaacgccgaagauaugggaaauggcugcuuuaagauuuaucauaaaugugacaacgcuugcaucgggucuauucgcaauggcaccuacgaucacgacguguaccgggacgaggcccucaacaauagauuccagaucaagggagucgagcugaaauccggcuauaaggauuggauccuuuggauuagcuuugccaucuccugcuuccugcucuguguggcucugcugggguuuauuaugugggccugccagaaaggaaacauccgcuguaauauuugcaucuga

SEQ ID NO: 191805 - RNA, 1698 nt, Artificial Sequence; identical to SEQ ID NO: 191802
  derived and/or modified sequence opt5 from hemagglutinin__InfluenzaA__AFJ74694

SEQ ID NO: 191806 - RNA, 1701 nt, Artificial Sequence
  derived and/or modified sequence opt5 from hemagglutinin__InfluenzaA__AFJ74695
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacaggcagaauuugcgacuccccgcaccagauccuggauggggagaacuguacccucaucgacgcccugcugggagauccccauugcgacggcuuucagaauaaagaaugggaucucuucgucgagcggucuaaggccuauagcaacuguuacccuuaugacgugcccgauuacguuucccugcgcucucuuguggcuagcuccgggacgcuggaauuuaauaacgagagcuucaauuggaccggagucgcccaggacggcacaucuuccgcuugcaaaagacggagcgauaaguccuuuuucucucgccucaacuggcugcaccagcuuaaguauaaauacccugcccugaaugugaccaugcccaacaaugagaaguuugacaaacucuauauuuggggcguucaucacccugggacagauagcgaccagaucucucuguacgcgagagccuccggacgggugaccgucagcacgaagcgcucccagcaaacagugauuccgaacaucggcucuagacccugggugagaggggucagcuccaaaauuagcaucuacuggaccauuguuaagccuggagacauccugcucaucaacucuacaggcaaucugauugcuccccgcggguauuucaagaucagauccggaaaaagcucuauuaugcggagcgaugccccuaucggcaaguguaacuccgaaugcauuacccccaauggcucuaucccgaacgacaaaccuuuucagaaugugaaccgcaucaccuacgggcccuguccuagauaugugaagcagaauacacuuaaacuggcuacgggaaugcggaacguccccgagaagcagacccgcggcauuuucggggccaucgcgggauuuauugaaaauggcugggaggggaugguggauggaugguacggcuucagacaccaaaacagcgagggcacagggcaggccgcugaccucaaauccacccaggccgcuaucaaucaaauuaacggaaagcugaaucggcuuaucgaaaagacaaacgagaaauuucaucagaucgaaaaggaguucagcgaaguugagggccggauucaggaucuggagaaauauguggaagacaccaagaucgaucucuggucuuacaaugccgagcugcuggucgcccucgaaaaccagcacacgauugaccugacagauuccgagaugaacaaacuuuucgaacgcaccaagaagcaacugcgggagaaugcugaggacauggggaacggaugcuuuaaaaucuaucauaagugugauaaugcgugcauuggcagcaucagaaacgggaccuacgaccacgacguguaccgcgaugaagcccucaauaaccgguuccagauuaaaggcguugagcugaagucuggauauaaagacuggauccuuuggaucuccuuugcuauuagcugcuuccugcucuguaucgugcugcugggcuuuauuaugugggccugccagaaggggaauaucagauguaacauuugcaucuga

SEQ ID NO: 191807 - RNA, 1701 nt, Artificial Sequence
  derived and/or modified sequence opt5 from hemagglutinin__InfluenzaA__AFJ74727
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacagcugaaauauaaguacccugcccuuaacgucaccaugcccaauaacgagaaauuugacaagcuguauaucuggggagugcaucacccugggacggauucugaccagauuucccucuacgcgcaagccagcggccgcaucacaguuuccaccaaaagaucucagcagacagugauuccgaacaucgggagccggccccgcgucagagauauuuccagccggaucucuaucuacuggaccauugugaagccuggagacauccugcugauuaauuccaccggcaaccucaucgcuccccgcggguauuucaagauuagaagcggaaaaucuagcaucaugcgguccgacgccccuaucggcaaguguaauucugagugcauuacacccaacggcagcaucccgaaugauaaaccuuuucagaacgugaaucgcauuacguacggggcuugucccagauaugucaagcaaaacacccugaaacuugccacaggaaugcggaauguuccugaaaagcagacccgcggcaucuucggggcgauugccggauuuaucgagaacggcugggaagggaugguggacggaugguacggcuucagacaucaaaauuccgagggcacagggcaggcugccgaucugaaaagcacccaggcugccaucaaccagauuaauggaaagcucaaccggcugaucggcaagacgaaugagaaauuucaccagauugaaaaggaguucucugaaguggaggggagaauccaagaccuugaaaaauaugucgaggauacaaagauugaccugugguccuacaacgccgagcuccugguggcucuggaaaaccagcacaccaucgaucucaccgacagcgagaugaauaaacuguucgaacgcacaaagaagcagcuucgggagaacgcggaagauaugggaaauggcugcuuuaaaauuuaucauaagugugacaacgccugcaucgggucuaucagauccggcaccuacgaucacgacguuuaccgcgacgaggcucugaauaaccgguuccagauuaaaggaguggagcucaagagcggcuauaaagauuggauccuguggauuuccuuugccaucucuugcuuccuucugugugucgcccuccugggguuuauuaugugggcuugccaaaagggaaauaucagauguaacaucugcauuuga

SEQ ID NO: 191808 - RNA, 1698 nt, Artificial Sequence; identical to SEQ ID NO: 191802
  derived and/or modified sequence opt5 from hemagglutinin__InfluenzaA__AFJ74743

SEQ ID NO: 191809 - RNA, 1701 nt, Artificial Sequence; identical to SEQ ID NO: 191801
  derived and/or modified sequence opt5 from hemagglutinin__InfluenzaA__AFJ74744

SEQ ID NO: 191810 - RNA, 1698 nt, Artificial Sequence; identical to SEQ ID NO: 191802
  derived and/or modified sequence opt5 from hemagglutinin__InfluenzaA__AFJ74760

SEQ ID NO: 191811 - RNA, 1701 nt, Artificial Sequence
  derived and/or modified sequence opt5 from hemagglutinin__InfluenzaA__AFJ74761
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacagcugaaauauaaguacccugcccuuaacgucaccaugcccaauaacgagaaauuugacaagcuguauaucuggggagugcaucacccugggacggauucugaccagauuucccucuacgcgcaagccagcggccgcaucacaguuuccaccaaaagaucucagcagacagugauuccgaacaucgggagccggccccgcgucagagauauuuccagccggaucucuaucuacuggaccauugugaagccuggagacauccugcugauuaauuccaccggcaaccucaucgcuccccgcggguauuucaagauuagaagcggaaaaucuagcaucaugcgguccgacgccccuaucggcaaguguaauucugagugcauuacacccaacggcagcaucccgaaugauaaaccuuuucagaacgugaaucgcauuacguacggggcuugucccagauaugucaagcaaaacacccugaaacuugccacaggaaugcggaauguuccugaaaagcagacccgcggcaucuucggggcgauugccggauuuaucgagaacggcugggaagggaugguggacggaugguacggcuucagacaucaaaauuccgagggcacagggcaggcugccgaucugaaaagcacccaggcugccaucaaccagauuaauggaaagcucaaccggcugaucggcaagacgaaugagaaauuucaccagauugaaaaggaguucucugaaguggaggggagaauccaagaccuugaaaaauaugucgaggauacaaagauugaccugugguccuacaacgccgagcuccugguggcucuggaaaaccagcacaccaucgaucucaccgacagcgagaugaauaaacuguucgaacgcacaaagaagcagcuucgggagaacgcggaagauaugggaaauggcugcuuuaaaauuuaucauaagugugacaacgccugcaucgggucuaucagaaauggcaccuacgaucacgacguuuaccgcgacgaggcucugaacaaucgguuccagauuaaaggaguggagcucaaguccggcuauaaagauuggauccuguggauuagcuuugccaucuccugcuuccuucugugugucgcccuccugggguuuauuaugugggcuugccaaaagggaaacaucagauguaauaucugcauuuga

SEQ ID NO: 191812 - RNA, 1698 nt, Artificial Sequence; identical to SEQ ID NO: 191802
  derived and/or modified sequence opt5 from hemagglutinin__InfluenzaA__AFJ74779

SEQ ID NO: 191813 - RNA, 1701 nt, Artificial Sequence; identical to SEQ ID NO: 191801
  derived and/or modified sequence opt5 from hemagglutinin__InfluenzaA__AFJ74780

SEQ ID NO: 191814 - RNA, 1701 nt, Artificial Sequence
  derived and/or modified sequence opt5 from hemagglutinin__InfluenzaA__AFJ74804
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacagaaaaugggaucuguucgucgaacggagcaaggccuauuccaauuguuacccuuaugacgugcccgauuacgcuucucuccgcagccugguugccuccagcggaacgcuugaguuuaacaaugaaucuuucgacuggaccggcgugacacagaacggcaccuccagcgcuugcaaaagacggucuaauaaguccuuuuucagccgccugaacuggcucacacaucugaaguauaaauacccugcccuuaaugucaccaugcccaacaaugagaaguuugauaaacuguauaucuggggagugcaccauccugggacggacucugaucagauuucccucuacgcgcaggccagcggcagaaucacaguuuccaccaagcggucucaacagacagugauuccgaacaucgggagccgccccagaguccgggacguguccagccgcauuucuaucuacuggaccaucgugaaaccuggagacauucugcugaucaacuccaccggcaaucucauugcucccagaggguauuucaagauccggagcggaaagucuagcauuaugcgcuccgaugccccuaucggcaaauguaacucugagugcaucacacccaauggcagcauuccgaacgacaagccuuuucagaaugucaacagaaucacguacggggcuuguccccgguauguuaaacagaauacccugaaacuugccacaggaaugcgcaacgugccugaaaaacaaaccagaggcauuuucggggcgaucgccggauuuauugagaauggcugggaagggaugguggauggaugguacggcuuccggcaccagaacuccgagggcacagggcaggcugccgaccucaagagcacccaagcugccaucaaucagaucaacggaaaacugaauagacugauuggcaagacgaacgagaaguuucaccagaucgaaaaagaguucucugaagucgaggggcgcauucaggaucuugaaaaguauguggaggacacaaaaaucgaucugugguccuacaaugccgagcuccugguugcucuggaaaaccaacauaccauugaccucaccgauagcgagaugaacaagcuguucgaacggacaaagaagcagcuuagagagaaugcggaagacaugggaaacggcugcuuuaagaucuaucacaaaugugauaaugccugcauugggucuauccgcaacggcaccuacgaccaugacguguaccgggaugaggcucugaauaacagauuccagaucaagggagucgagcucaaauccggcuauaaggacuggauucuguggaucagcuuugccauuuccugcuuccuucuguguguggcccuccugggguuuaucaugugggcuugccagaaaggaaauauucgcuguaacaucugcaucuga

SEQ ID NO: 191815 - RNA, 1701 nt, Artificial Sequence
  derived and/or modified sequence opt5 from hemagglutinin__InfluenzaA__AFJ74819
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuaaccucuacgcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguauuucaagaucagauccggaaaaagcucuauuaugcggagcgaugccccuaucggcaaguguaauuccgagugcaucacacccaacggcucuauuccgaaugacaaaccuuuucagaacgucaaucgcaucacguacggggcuugucccagauauguuaagcagaacacccugaaacuugccacaggaaugcggaaugugccugaaaagcaaacccgcggcauuuucggggcgaucgccggauuuauugagaacggcugggaagggaugguggauggaugguacggcuucagacaccagaauagcgagggcacagggcaggcugccgaccugaaauccacccaagcugccaucaaccagaucaauggaaagcucaaccggcugauuggcaagacgaaugagaaauuucaccagaucgaaaaggaguucagcgaagucgaggggcgcauucaggaucuugaaaaauauguggaggacacaaagaucgaucuguggucuuacaacgccgagcuccugguugcucuggaaaaccaacauaccauugaccucaccgauuccgagaugaauaaacuguucgaaagaacaaagaagcagcuucgggagaacgcggaagacaugggaaauggcugcuuuaaaaucuaucacaagugugauaacgccugcauugggagcaucagaaauggcaccuacgaccaugacguguaccgcgaugaggcucugaacaaucgguuccagaucaaaggagucgagcucaagucuggcuauaaagacuggauucuguggaucuccuuugccauuagcugcuuccuucuguguguggcccuccugggguuuaucaugugggcuugccagaagggaaacauuagauguaauaucugcaucuga

SEQ ID NO: 191816 - RNA, 1701 nt, Artificial Sequence; identical to SEQ ID NO: 185669
  derived and/or modified sequence opt5 from hemagglutinin__InfluenzaA__AFJ74842

SEQ ID NO: 191817 - RNA, 1698 nt, Artificial Sequence
  derived and/or modified sequence opt5 from hemagglutinin__InfluenzaA__AFJ75036
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagaauagcuggccuaaccacacggugaccggaguuucugccuccugcagccauaauggcaagucuuccuuuuauaaaaaccugcuuuggcugacaggcaagaaugggcucuaccccaaccugagcaaaucuuaugcuaauaacaaggaaaaagaggugcugguccucuggggagugcaccacccuccgaacaucggcgaucagagagcccuguaccauaccgaaaaugcuuacguguccgucguuagcucccacuauucucggaaguucacacccgagauugccaagcgcccuaaagugagagaccaggaagggcggaucaacuacuauuggacccuucuggagcccggagauacgauuaucuuugaggcgaauggcaaccucauugccccucgcuacgcuuucgcccugagcagaggguuuggauccggcaucauuaauagcaacgcucccauggacgaaugugaugccaagugccagacaccgcaaggcgcgaucaauucuucccuuccuuuccagaacgugcaucccgucaccaucggggaguguccuaaauaugugcggagcgccaagcugcgcaugguuacaggacucagaaauauucccucuauccagagccggggccuguuuggggcuauugccggauucaucgaaggcggguggaccggaaugguggacggcugguacggcuaucaccaccagaacgagcaaggguccggauacgcugccgaucagaaaucuacccagaaugccauuaacggcaucacaaauaaggucaacagcgugaucgaaaagaugaauacgcaguuuaccgcuguugggaaagaguucaacaagcuggagcgcagaauggaaaaccucaauaaaaagguggacgauggauucauugacaucuggacauacaacgcggagcugcuuguccugcucgaaaaugagcggacccuggacuuucaugauuccaacgugaaaaaucuuuaugaaaaggucaaaagccaacugaagaacaaugccaaggagauuggcaacgggugcuucgaguuuuaccacaaauguaaugacgaaugcauggagucugugaagaacggcacauaugauuaccccaaauauuccgaagagagcaagcucaaucgcgagaaaaucgacggaguuaagcuggaaucuaugggcguguaccagauucuggcuaucuauuccaccgucgccagcucccucgugcugcuuguuucucugggggccaucagcuucuggaugugcuccaacggaucucuccaguguagaauuugcaucuga

SEQ ID NO: 191818 - RNA, 1701 nt, Artificial Sequence; identical to SEQ ID NO: 183654
  derived and/or modified sequence opt5 from hemagglutinin__InfluenzaA__AFJ75047

SEQ ID NO: 191819 - RNA, 1698 nt, Artificial Sequence
  derived and/or modified sequence opt5 from hemagglutinin__InfluenzaA__AFJ75058
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacggugaccggaguuuccgccagcugcucucauaacggcaaguccagcuuuuauaaaaaucugcuuuggcugacaggcaagaacgggcucuaccccaaucugucuaaauccuaugcuaacaauaaggaaaaagaggugcugguccucuggggagugcaccacccuccgaacaucggcgaucagagagcccuguaccauaccgaaaacgcuuacgugagcgucguuuccucucacuauagccggaaguucacacccgagauugccaagcgcccuaaagugagagaccaggaagggcggaucaauuacuauuggacccuucuggagcccggagauacgauuaucuuugaggcgaacggcaaucucauugccccucgcuacgcuuucgcccuguccagaggguuuggaagcggcaucauuaacucuaaugcucccauggacgaaugugaugccaagugccagacaccgcaaggcgcgaucaacuccagccuuccuuuccagaaugugcaucccgucaccaucggggaguguccuaaauaugugcggucugccaagcugcgcaugguuacaggacucagaaacauucccagcauccagucccggggccuguuuggggcuauugccggauucaucgaaggcggguggaccggaaugguggacggcugguacggcuaucaccaccagaaugagcaagggucuggauacgcugccgaucagaaaagcacccagaacgccauuaauggcaucacaaacaaggucaauuccgugaucgaaaagaugaacacgcaguuuaccgcuguugggaaagaguucaauaagcuggagcgcagaauggaaaaccucaacaaaaagguggacgauggauucauugacaucuggacauacaaugcggagcugcuuguccugcucgaaaacgagcggacccuggacuuucaugauagcaaugugaaaaaccuuuaugaaaaggucaaaucucaacugaagaauaacgccaaggagauuggcaaugggugcuucgaguuuuaccacaaauguaacgacgaaugcauggaguccgugaagaauggcacauaugauuaccccaaauauagcgaagagucuaagcucaaccgcgagaaaaucgacggaguuaagcuggaauccaugggcguguaccagauucuggcuaucuauagcaccgucgccuccucucucgugcugcuuguuagccugggggccaucuccuucuggaugugcucuaauggaagccuccaguguagaauuugcaucuga

SEQ ID NO: 191820 - RNA, 1698 nt, Artificial Sequence
  derived and/or modified sequence opt5 from hemagglutinin__InfluenzaA__AFJ75069
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaauccaauccggagaacggcaccuguuaucccgggcauuuugccgacuacgaggaacugcgggagcaacucucuagcgucuccagcuucgaacgcuuugagaucuucccuaaggagucuuccuggcccaaucacacgaccacaggagugagcgccucuugcucccauaacggcgaaagcucuuuuuauaagaaucugcuuuggcugaccggcaaaaacgggcucuacccuaaucuguccaagagcuaugcuaacaauaaagagaaggaaguucuggugcucuggggaguccaccaucccccuaacaucggcgaucagagagcccuguaccacacagagaacgcuuacguguccguggucucuagccacuauucccggaaauucaccccggaaauugccaagcgccccaagguuagagaccaggaggggcggaucaauuacuauuggacgcuucuggagccuggagauacaauuaucuuugaagcgaacggcaaucucauugcuccccgcuacgccuucgcccugagcagaggguuuggaucuggcaucauuaacuccaaugcuccuauggacgagugugaugccaaaugccagacaccccaaggcgcgaucaacagcucucuuccguuccagaaugugcauccugugaccaucggggaaugucccaaguauguccggagcgccaaacugcgcauggugaccggacucagaaacauuccuuccauccagucucggggccuguuuggggcuauugccggauucaucgagggcggguggaccggaaugguugacggcugguacggcuaucaccaccagaaugaacaagggagcggauacgcugccgaucagaaguccacacagaacgccauuaauggcaucacgaacaaagugaauagcgucaucgagaagaugaacacccaguuuacagcuguggggaaagaguucaauaagcuggaacgcagaauggagaaccucaacaagaaaguugacgauggauucauugacaucuggaccuacaaugcggaacugcuugugcugcucgagaacgaacggacacuggacuuucaugauucuaaugucaagaaccuuuaugagaaagugaagucccaacugaaaaauaacgccaaggagauuggcaaugggugcuucgaauuuuaccacaaguguaacgacgagugcauggaaagcgucaaaaauggcaccuaugauuaccccaaguauucugaggaguccaaacucaaccgcgaaaagaucgacggagugaaacuggagagcaugggcguuuaccagauucuggcuaucuauuccacgguggccucuagccucguccugcuugugucccugggggccaucucuuucuggaugugcagcaauggaucccuccaguguagaauuugcaucuga

SEQ ID NO: 191821 - RNA, 1701 nt, Artificial Sequence
  derived and/or modified sequence opt5 from hemagglutinin__InfluenzaA__AFJ75091
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagauuagccaacagacagugaucccgaacauuggguccagaccccggguccgcaauaucccuucuagaaucagcauuuacuggaccaucgugaaacccggagauauucugcugaucaacuccaccggcaaucucauugcuccucggggguacuucaagauccgcagcggaaagucuuccaucaugagaagcgacgcccccauuggcaaauguaacucugagugcaucacaccgaauggcagcauuccuaacgacaagcccuuucagaaugugaaccggaucacguauggggcuuguccucgcuacgucaaacagaauacccugaaacuugccacaggaaugagaaacguucccgaaaagcaaacccggggcauuuucggggcgaucgccggauuuaucgagaauggcugggaagggaugguggauggaugguauggcuuccgccaccagaacuccgagggcauugggcaggcugccgaccugaagucuacacaagcugccaucgaucagauuaauggaaaacucaacagacugaucggcaagaccaacgagaaguuccaccagauugaaaaagaguuuagcgaaguggaggggcggauccaggaccuugaaaaguacgucgaggauacgaaaauugaccugugguccuauaaugccgaucuccugguggcucuggagaaccaacauacaaucgaccucaccgauagcgaaaugaauaagcuguucgagaaaaccaagaagcagcuuagagaaaacgcggaggacaugggaaauggcugcuuuaaaaucuaccacaagugugauaacgccugcauugggucuauccgcaauggcacauaugaccaugacguuuaccgggaugaagcucugaacaauagauuccagauuaaaggaguggagcucaaguccggcuacaaagacuggauccuguggauuagcuuugccaucucuugcuuccuucugugugucgcccuccugggguuuaucaugugggcuugccagaagggaaacauucgcuguaauaucugcauuuga

SEQ ID NO: 191822 - RNA, 1701 nt, Artificial Sequence
  derived and/or modified sequence opt5 from hemagglutinin__InfluenzaA__AFJ75449
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggaaaaauuacaguuuccaccaagcgcagccaacagacagugaucccgaacauuggcuccagaccccggguccgcaauaucccuucuagaaucagcauuuacuggaccaucgugaaacccggggauauucugcugaucaacuccaccggaaaucucauugcuccucggggcuacuucaagauccgcagcgggaagucuuccaucaugagaagcgacgcccccauuggaaaauguaacucugaaugcaucacaccgaauggcagcauuccuaacgacaagcccuuucagaaugugaaccggaucacguauggcgcuuguccucgcuacgucaaacagaauacccugaaacuugccacagggaugagaaacguucccgagaagcaaacccggggaauuuucggcgcgaucgccggguuuaucgaaaauggaugggagggcaugguggaugggugguauggauuccgccaccagaacuccgagggcacaggccaggcugccgaccugaagucuacccaagcugccauugaucagaucaaugggaaacucaacagacugauuggaaagacgaacgaaaaguuccaccagaucgagaaagaauuuagcgagguggaaggccggauucaggaccuugagaaguacgucgaggauacaaaaaucgaccugugguccuauaaugccgaacuccugguggcucuggagaaccaacauaccauugaucucaccgacagcgaaaugaauaagcuguucgagaaaacaaagaagcagcuuagagaaaacgcggaggauauggggaauggaugcuuuaaaaucuaccacaagugugacaacgccugcaucggcucuauucgcaaugggaccuaugaucaugacguuuaccgggacgaggcucugaacaauagauuccagaucaaaggcguggaacucaaguccggauacaaagauuggauucuguggaucagcuuugccauuucuugcuuccuucugugugucgcccuccugggcuuuaucaugugggcuugccagaaggggaacauccgcuguaauauuugcaucuga

SEQ ID NO: 191823 - RNA, 1701 nt, Artificial Sequence
  derived and/or modified sequence opt5 from hemagglutinin__InfluenzaA__AFJ75460
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaauuucgacaaacuguacauuuggggcgugcaccauccugggacagauaacgaccagaucuuucucuaugcccaggcgucuggacgcauuaccguuuccacaaagagaagccaacagaccgugaucccgaauauuggcucccggccccgcgucagaaacaucccuucucggaucagcauuuacuggaccaucgugaaacccggggauauucugcugaucaauuccacaggaaaccucauugccccucgcggcuacuucaagaucagaagcgggaaaucuuccaucaugcggagcgacgcucccauuggaaaguguaauucugaaugcaucacgccgaacggcagcauuccuaaugacaagcccuuucagaacgugaaucgcaucaccuauggcgccuguccuagauacgucaaacagaacacacugaaacuugcuaccgggaugcggaauguucccgagaagcaaacacgcggaauuuucggcgccaucgcgggguuuaucgaaaacggaugggagggcaugguggaugggugguauggauucagacaccaaaauuccgagggcauuggccaggccgcugaccugaagucuacccaggccgcuguggaucagaucaacgggaaacucaaccggcugauuggaaagacgaaugaaaaauuccaccagaucgagaaggaauuuagcgaggucgaaggccgcauucaggaccuugagaaguacguggaggauacaaaaaucgaccugugguccuauaacgccgaacuccugguugcccuggagaaucaacauaccauugaucucaccgacagcgaaaugaacaagcuguucgagaaaacaaagaaacagcuuagagaaaaugcugaggauauggggaacggaugcuuuaagaucuaccacaagugugacaaugcgugcaucggcucuauucggaacgggaccuaugaucaugacguguacagagacgaggcccugaauaaccgcuuccagaucaaaggcgucgaacucaaguccggauacaaagauuggauucuguggaucagcuuugcuauuucuugcuuccuucuguguguggcccuccugggcuuuaucaugugggccugccagaaggggaauauccgguguaacauuugcaucuga

SEQ ID NO: 191824 - RNA, 1698 nt, Artificial Sequence
  derived and/or modified sequence opt5 from hemagglutinin__InfluenzaA__AFJ75517
augaaggugaaacugcucguccugcuuugcaccuucacagccacguacgcugacaccaucuguauuggcuaucacgccaacaauagcacagauaccguugacacagugcuggagaagaacgugaccgucacauacuccgugaaucuccuggaagauaaccauaaugggaaacuuugccugcucaagggaaucgcgccccugcagcugggcaacuguucuguugcuggguggauucucggaaauccugagugcgaacugcuuaucagcaaagaguccuggucuuauauuguggaaagaccgaaccccgagaauggcaccuguuacccugggcacuuugccgacuaugaggaacugcgggagcaacucagcuccgucucuagcuucgaacgcuuugagaucuuccccaaggaguccagcuggccuaaccauacggugaccggaguuucugccuccugcagccacaauggcgaaucuuccuuuuacaagaaccugcuuuggcugacaggcaaaaaugggcucuaucccaaccugagcaagucuuacgcuaauaacaaagagaaggaagugcugguccucuggggagugcaucacccuccgaacaucggcgaucagaugacccuguaccacaaaaagaaugccuauguguccgucguuagcucccauuacucuagaaaguucacacccgagauugcuaaacggccuaaggugcgcgaccaggaagggagaaucaacuauuacuggacccuucuggagcccggagauacgauuaucuuugaggccaauggcaaccucauugcgccucgguaugccuucgcucugaaucgcggguuuggaagcggcaucauuaacuccaaugcccccauggacgaaugugaugcuaaaugccagacaccgcaaggcgccaucaacagcucucuuccuuuccagaaugugcaccccgucaccaucggggaguguccuaaguacgugagauccgcgaaacugcggaugguuacaggacuccgcaacauucccagcauccagucuagaggccuguuuggggccauugcuggauucaucgaaggcggguggaccggaaugguggacggcugguauggcuaccaucaccagaaugagcaagggagcggauacgccgcugaucagaaguccacccagaacgccauuaauggcaucacaaacaaagucaauucugugaucgaaaagaugaacacgcaguuuaccgccguugggaaggaguucaacaaacuggagcggcgcauggaaaaucucaacaagaaaguggacgauggauucauugacgucuggacauauaaugcugagcugcuugugcugcucgaaaacgagagaacccuggacuuucacgauagcaaugucaagaaccuuuacgaaaaagugaagacacaacugaagaauaacgcgaaagagaucggcaaugggugcuucgaguuuuaucauaaguguaacgacgaaugcauggaguccguuaaaaauggcaccuacgauuaucccaaguacagcgaagagucuaaacucucccgggagaagauugacggagugaagcuggaaagcaugggcgucuaucagauccuggccauuuacucuacgguggcuuccagccucguucugcuugugucccugggggccaucucuuucuggaugugcagcaacggaucccuccagugucgcaucugcauuuga

SEQ ID NO: 191825 - RNA, 1698 nt, Artificial Sequence
  derived and/or modified sequence opt5 from hemagglutinin__InfluenzaA__AFJ75560
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauaagaaccugcuuuggcugacaggcaaaaaugggcucuaccccaaccugagcaagucuuaugcuaauaacaaagagaaggaagugcugguccucuggggagugcaccacccuccgaacaucggcgaucagaugacccuguaccauaaagagaaugccuacguguccgucguuagcucccacuauucuagaaaguucacacccgaaauugcuaagcggccuaaagugcgcgaccaggaggggagaaucaacuacuauuggacccuucuggagcccggagauacgauuaucuuugaagccaauggcaaccucauugcgccucgguacgccuucgcucugagccgcggguuuggauccggcaucauuaauagcaacgcccccauggacgagugugaugcuaagugccagacaccgcaaggcgccaucaauucuucccuuccuuuccagaacgugcaucccgucaccaucggggaauguccuaaauuugugagaagcgcgaagcugcggaugguuacaggacuccgcaauauucccucuauccagagcagaggccuguucggggccauugcuggauuuaucgagggcggguggaccggaaugguggacggcugguauggcuaccaccaccagaacgaacaaggguccggauaugccgcugaucagaaaucuacccagaaugccauuaacggcaucacaaauaaggucaacagcgugaucgagaaaaugaauacgcaguucaccgccguugggaaggaguucaacaagcuggaacggcgcauggagaaccucaauaaaaagguggacgauggauuuauugacgucuggacauacaacgcugaacugcuugugcugcucgagaaugaaagaacccuggacuuccaugauuccaacgucaaaaaucuuuacgagaaggugaaaaaccaacugcggaauaacgcgaaggagaucggcaaugggugcuuugaguucuaucacaaguguaacgacgaaugcauggaaagcguuaaaaauggcacauacgauuaucccaaguacucugaggaguccaaacucagccgcgaaaagauugacggagugaaacuggagucuaugggcgucuaucagauccuggccauuuacuccaccguggcuagcucccucguucugcuugugucucugggggccaucagcuuuuggaugugcuccaacggaucucuccaguguagaaucugcauuuga

SEQ ID NO: 191826 - RNA, 1698 nt, Artificial Sequence
  derived and/or modified sequence opt5 from hemagglutinin__InfluenzaA__AFJ75571
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaaacucuuuuuauaagaaucugcuuuggcugacaggcaaaaacgggcucuaccccaaucuguccaagagcuaugcuaacaacaaagagaaggaagugcugguccucuggggagugcaccacccuccgaauaucggcgaucagaugacccuguaccauaaagagaacgccuacgugucugucguuuccagccacuauuccagaaaguucacacccgaaauugcuaagcggccuaaagugcgcgaccaggaggggagaaucaauuacuauuggacccuucuggagcccggagauacgauuaucuuugaagccaacggcaaucucauugcgccucgguacgccuucgcucugucucgcggguuuggaagcggcaucauuaacuccaaugcccccauggacgagugugaugcuaagugccagacaccgcaaggcgccaucaacagcucucuuccuuuccagaaugugcaucccgucaccaucggggaauguccuaaauaugugagauccgcgaagcugcggaugguuacaggacuccgcaacauucccagcauccagucuagaggccuguuuggggccauugcuggauucaucgagggcggguggaccggaaugguggacggcugguacggcuaucaccaccagaaugaacaagggagcggauacgccgcugaucagaaauccacccagaacgccauuaauggcaucacaaacaaggucaauucugugaucgagaaaaugaacacgcaguuuaccgccguugggaaggaguucaacaagcuggaacggcgcauggagaaucucaacaaaaagguggacgauggauucauugacgucuggacauacaaugcugaacugcuugugcugcucgagaacgaaagaacccuggacuuucaugauagcaaugucaaaaaccuuuaugagaaggugaaaaaucaacugaagaacaaugcgaaggagaucggcaacgggugcuucgaauuuuaccacaaauguaaugacgagugcauggaauccguuaagaacggcacauaugauuaccccaaauauagcgaggagucuaagcucucccgggaacgcauugacggagugaaacuggagagcaugggcgucuaccagauccuggccauuuauucuaccguggcuuccagccucguucugcuugugucccugggggccaucucuuucuggaugugcagcaauggaucccuccaguguagaaucugcauuuga

SEQ ID NO: 191827 - RNA, 1701 nt, Artificial Sequence
  derived and/or modified sequence opt5 from hemagglutinin__InfluenzaA__AFJ75593
augaagaccaucauugcccugagcuacauccucugccugguguucgcucagaaacuucccggcaacgacuccucuacagccacgcugugucucgggcaccaugcggucccuaauggaaccauuguuaagacaaucaccaacgaucaaauugaggugacaaaugcuaccgaacuggugcagagcuccucuacaggcgagaucugcaacagcccgcaccagauccuugacggggaaaauuguacccugauugaugcccuccugggagacccccagugcgauggcuuucaaaacaaaaagugggaccuguucgucgagagauccaaagccuauucuaauuguuacccuuaugaugugcccgacuacgcuagccuccggucccugguugccagcucugggacgcuugaauuuaacaaugaguccuucaacuggaccggagugacacagaauggcaccagcucugcuugcauccgcagauccaacaauagcuuuuucucucggcugaacuggcucacacaucugaaguuuaaguauccugcccuuaaugucaccaugcccaacaacgagaaauucgauaagcuguacauuuggggcgugcaccauccugggacggacaaugaucagaucuuucucuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggacauucugcugaucaacagcaccggaaaucucauugcuccucgcggcuacuucaaaaucagaucugggaaguccagcaucaugcggucugaugcccccauuggaaaguguaacagcgaaugcaucacaccgaauggcuccauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggacgggugguauggauucagacaccagaacucugagggcauuggccaggcugccgaucugaaaagcacacaagcugccaucgaccagauuaaugggaagcucaaccggcugaucggaaaaaccaacgaaaaguuccaccagauugagaaggaauuuuccgagguggaaggcagaauccaggaucuugagaaauacgucgaggacacgaagguggaucuguggagcuauaaugccgaacuccugguugcucuggagaaccaacauacaauugaccucaccgauucugaaaugaauaaacuguucgagaagaccaaaaagcagcuucgcgaaaacgcggaggacauggggaauggaugcuuuaagaucuaccacaaaugugauaacgccugcaucggcuccauucggaaugggacauaugaccaugauguguacagagacgaggcucugaacaaucgcuuccagaucaagggcgucgaacucaaaagcggauacaaggacuggauucuguggaucucuuuugccauuuccugcuuccuucuguguguggcccuccugggcuuuaucaugugggcuugccagaaagggaacauccgguguaauauuugcaucuga

SEQ ID NO: 191828 - RNA, 1698 nt, Artificial Sequence
  derived and/or modified sequence opt5 from hemagglutinin__InfluenzaA__AFJ75615
augaaggugaaacugcucguccugcuuugcaccuucacagccacguacgcugacaccaucuguguuggcuaucacgccaacaauagcacagauaccguggacacagugcuggagaagaacgucaccgugacacauuccguuaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucgucgaaaagccgaaccccgagaauggcaccuguuauccugggcauuuugccgauuacgaggaacugagagagcaacucuccucugugagcuccuucgaacgguuugagauuuuccccaaggagagcucuuggccuaaccacacgguuaccggaguguccgccagcugcucucauaauggcgaauccagcuuuuaucgcaaccugcuuuggcugacaggcaaaaaugggcucuaccccaaccugucuaaguccuaugcuaauaacaaagagaaggaaguccuggugcucuggggagugcaccacccuccgaacaucggcgaccagaaagcccuguaccauaccgagaaugcuuacgucagcguuguguccucucacuauagcagaaaguucacacccgaaaucgccaagcggccuaaagugcgcgaucaggaggggagaauuaacuacuauuggacccuucuggagcccggagacacgaucauuuuugaagcgaauggcaaccucaucgccccucgguacgcuuucgcccugucccgcggguuuggaagcggcauuaucaauucuaacgcucccauggauaagugugacgccaaaugccagacaccgcaaggcgcgauuaauuccagccuuccuuuccagaacguccaucccgugaccaucggggaguguccuaaguauguuagaucugccaaacugcggauggugacaggacuccgcaauauccccagcauucaguccagaggccuguuuggggcuaucgccggauucauugaaggcggguggaccggaauggucgauggcugguacggcuaucaccaccagaacgagcaagggucuggauacgcugccgaccaaaagagcacccagaaugccaucaacggcauuacaaauaaagugaacuccguuaucgaaaagaugaauacgcaguuuaccgagguggggaaggaguucaacaaacuggaacggcgcauggagaaccucaauaagaaagucgaugacggauucaucgauauuuggacauacaacgcugaacugcuugugcugcucgagaaugaaagaacccuggacuuucaugacagcaacgucaagaaucuuuaugagaaagugaagucucagcugaagaacaaugcgaaagagaucggcaacgggugcuucgaauuuuaccacaaguguaaugaugagugcauggaauccguuaaaaacggcacauaugacuaccccaaguauagcgaggagucuaaacucaaucgggaaaagauugauggagugaagcuggaguccaugggcgucuaccagauccuggccauuuauagcaccguggcuuccucucucguucugcuugugagccugggggccaucuccuucuggaugugcucuaacggaagccuccagugucgcaucugcauuuga

SEQ ID NO: 191829 - RNA, 1701 nt, Artificial Sequence; identical to SEQ ID NO: 188376
  derived and/or modified sequence opt5 from hemagglutinin__InfluenzaA__AFJ75630

SEQ ID NO: 191830 - RNA, 1701 nt, Artificial Sequence; identical to SEQ ID NO: 188376
  derived and/or modified sequence opt5 from hemagglutinin__InfluenzaA__AFJ75641

SEQ ID NO: 191831 - RNA, 1698 nt, Artificial Sequence
  derived and/or modified sequence opt5 from hemagglutinin__InfluenzaA__AFJ75651
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguacagaaccgagaaugcuuacgugagcgucguuuccucucauuauagccggaaguucacacccgaaauugccaagcgcccuaaagugagagaucaggaggggcggaucaacuacuauuggacccuucuggagcccggagacacgauuaucuuugaagcgaauggcaaccucauugccccucgcuacgcuuucgcccuguccagaggguuuggaagcggcaucauuaauucugaugcucccauggacaagugugaugccaaaugccagacaccgcaaggcgcgaucaacuccagccuuccuuuccagaaugugcaccccgucaccaucggggaguguccuaaguaugugcggucugccaaacugcgcaugguuacaggacucagaaacauucccagcauccagucccggggccuguuuggggcuauugccggauucaucgaaggcggguggaccggaaugguggacggcugguacggcuaucaucaccagaaugagcaagggucuggauacgcugccgaucaaaagagcacccagaacgccauuaauggcaucacaaacaaagucaauuccgugaucgaaaagaugaacacgcaguuuaccgcuguugggaaggaguucaauaaacuggagcgcagaauggaaaaccucaacaagaaaguggacgauggauucauugacaucuggacauacaaugcggagcugcuuguccugcucgaaaacgagcggacccuggacuuucacgauagcaaugugaagaaccuuuaugaaaaagucaagucucagcugaagaauaacgccaaagagauuggcaaugggugcuucgaguuuuaccauaaguguaacgacgaaugcauggaguccgugaaaaauggcacauaugauuaccccaaguauagcgaagagucuaaacucaaccgcgagaagaucgacggaguuaagcuggaauccaugggcguguaccagauucuggcuaucuauagcaccgucgccuccucucucgugcugcuuguuagccugggggccaucuccuucuggaugugcucuaauggaagccuccaguguagaauuugcaucuga

SEQ ID NO: 191832 - RNA, 1701 nt, Artificial Sequence
  derived and/or modified sequence opt5 from hemagglutinin__InfluenzaA__AFJ75662
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccugggacggauaaugaccagaucuuucucuaugcgcaggccucuggacgcauuacaguuuccaccaagagaagccaacagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacagaauacccugaaacuugccacagggaugcggaacguucccgaaaaacaaacccgcggaauuuucggcgcgaucgccggguuuaucgagaauggaugggagggcaugguggaugggugguauggauucagacaccagaacuccgaaggcacaggccaggcugccgaccugaagucuacccaagcugccauugaucagaucaaugggaaacucaaccggcugauuggaaagacgaacgagaaauuccaccagaucgaaaaggaguuuagcgaaguggagggccgcauucaggaccuugagaaguacgucgaagauacaaaaaucgaccugugguccuauaaugccgagcuccugguggcucuggaaaaccaacauaccauugaucucaccgacagcgagaugaauaagcuguucgaaaagacaaagaaacagcuuagagagaacgcggaggauauggggaauggaugcuuuaagaucuaccacaagugugacaacgccugcaucggcucuauucggaaugggaccuaugaucaugacguuuacagagacgaagcucugaacaaucgcuuccagaucaaaggcguggagcucaaguccggauacaaagauuggauucuguggaucagcuuugccauuucuugcuuccuucugugugucgcccuccugggcuuuaucaugugggcuugccagaaggggaacauccgguguaauauuugcaucuga

SEQ ID NO: 191833 - RNA, 1698 nt, Artificial Sequence
  derived and/or modified sequence opt5 from hemagglutinin__InfluenzaA__AFJ75673
augaaggugaaacugcucguccugcuuugcaccuucacagccacguacgcugacaccaucuguauuggcuaucacgccaacaauagcacagauaccguugacacagugcuggagaagaacgugaccgucacauacuccgugaaucuccuggaagauaaccauaaugggaaacuuugccugcucaagggaaucgcgccccugcagcugggcaacuguucuguugcuggguggauucucggaaauccugagugcgaacugcuuaucagcaaagaguccuggucuuauauuguggaaagaccgaaccccgagaauggcaccuguuacccugggcacuuugccgacuaugaggaacugcgggagcaacucagcuccgucucuagcuucgaacgcuuugagaucuuccccaaggaguccagcuggccuaaccauacggugaccggaguuucugccuccugcagccacaauggcgaaucuuccuuuuacaagaaccugcuuuggcugacaggcaaaaaugggcucuaucccaaccugagcaagucuuacgcuaauaacaaagagaaggaagugcugguccucuggggagugcaucacccuccgaacaucggcaaucagaugacccuguaccacaaagagaacgccuauguguccgucguuagcucccauuacucuagaaaguucacacccgaaauugcuaagcggccuaaagugcgcgaucaggaggggagaaucaauuauuacuggacccuucuggagcccggagacacgauuaucuuugaagccaacggcaaucucauugcgccucgguaugccuucgcucugaaccgcggguuuggaagcggcaucauuaauuccaacgcccccauggaugagugugacgcuaagugccagacaccgcaaggcgccaucaauagcucucuuccuuuccagaacgugcaccccgucaccaucggggaauguccuaaauacgugagauccgcgaagcugcggaugguuacaggacuccgcaauauucccagcauccagucuagaggccuguuuggggccauugcuggauucaucgagggcggguggaccggaaugguggauggcugguauggcuaccaucaccagaacgaacaagggagcggauacgccgcugaccagaaauccacccagaaugccauuaacggcaucacaaauaaggucaacucugugaucgagaaaaugaacacgcaguuuaccgccguugggaaggaguucaauaagcuggaacggcgcauggagaaccucaauaaaaagguggaugacggauucauugaugucuggacauauaacgcugaacugcuugugcugcucgagaaugaaagaacccuggacuuucacgacagcaacgucaaaaaucuuuacgagaaggugaaaacacaacugaagaacaaugcgaaggagaucggcaacgggugcuucgaauuuuaucauaaauguaaugaugagugcauggaauccguuaagaacggcaccuacgacuaucccaaauacagcgaggagucuaagcucucccgggagaaaauugauggagugaagcuggaaagcaugggcgucuaucagauccuggccauuuacucuacgguggcuuccagccucguucugcuugugucccugggggccaucucuuucuggaugugcagcaauggaucccuccagugucgcaucugcauuuga

SEQ ID NO: 191834 - RNA, 1701 nt, Artificial Sequence; identical to SEQ ID NO: 185693
  derived and/or modified sequence opt5 from hemagglutinin__InfluenzaA__AFJ76119

SEQ ID NO: 191835 - RNA, 1701 nt, Artificial Sequence; identical to SEQ ID NO: 186046
  derived and/or modified sequence opt5 from hemagglutinin__InfluenzaA__AFJ76131

SEQ ID NO: 191836 - RNA, 1701 nt, Artificial Sequence
  derived and/or modified sequence opt5 from hemagglutinin__InfluenzaA__AFJ76155
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgagcaggaagggagaaugaauuacuauuggacccuggucgagcccggagauaagaucacguucgaagccacaggcaaccugguugugccucgguacgcguuugccauggagcgcaaagcugggucuggaauuaucaucuccgacacccccgugcaugauugcaacacaaccugucaaaccccuaagggcgccauuaauacaagccuccccuuccagaacauccacucuauuacgaucggcaagugcccgaaauaugucaagagcaccaaacugagacuugcuacagggcugcggaaugugccuuccauucagucucgcggacucuuuggcgccaucgccggguucaucgaaggaggcuggaccgggaugguugacggaugguacggcuaucaucaccagaacgagcaaggcagcggguacgcugcggaccugaaguccacacagaaugccauugaugagaucaccaacaaagugaauagcgucauugaaaagaugaacacgcaguuuacagcugugggaaaggaguucaaucaccuugagaaaagaaucgagaaccugaauaagaaaguugacgauggcuuccucgacauuuggaccuacaacgccgaacugcuggugcuccuggagaaugagcggacccuugauuaucaugacucuaacgucaagaaucuguacgaaaaagugcgcucccagcucaagaacaacgccaaggagaucgggaauggauguuuugaguucuaucacaaaugcgauaacacauguauggaaagcgucaagaauggcaccuacgacuaucccaaauacucugaagaggcuaagcugaacagagaggaaaucgauggggugaaacuugaguccacacggauuuaucaaauccuggccauuuacagcacgguugcguccucucucgugcuggucgugagccugggcgcuaucuccuuuuggaugugcucuaauggaagccuccagugccgcauuuguaucuga

SEQ ID NO: 191837 - RNA, 1698 nt, Artificial Sequence
  derived and/or modified sequence opt5 from hemagglutinin__InfluenzaA__AFJ76186
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauuaccaagcggccuaaagugcgcgaucaggaggggagaaucaacuacuauuggacgcuucuggagcccggagacacaauuaucuuugaagccaauggcaaccucauugcgccucgguacgccuucgcucugucccgcggguuuggaagcggcaucauuaauucugaugcccccauggacaagugugaugcuaaaugccagaccccgcaaggcgccaucaacuccagccuuccuuuccagaaugugcaucccgucacaaucggggaguguccuaaguaugugagaucugcgaaacugcggaugguuaccggacuccgcaacauucccagcauccaguccagaggccuguuuggggccauugcuggauucaucgaaggcggguggaccggaaugguggacggcugguacggcuaucaccaccagaaugagcaagggucuggauacgccgcugaucaaaagagcacacagaacgccauuaauggcaucacgaacaaagucaauuccgugaucgaaaagaugaacacccaguuuacagccguugggaaggaguucaauaaacuggagcggcgcauggaaaaccucaacaagaaaguggacgauggauucauugacaucuggaccuacaaugcugagcugcuuguccugcucgaaaacgagagaacacuggacuuucaugauagcaaugugaagaaccuuuaugaaaaagucaagucucagcugaagaauaacgcgaaagagauuggcaaugggugcuucgaguuuuaccacaaguguaacgacgaaugcauggaguccgugaaaaauggcaccuaugauuaccccaaguauagcgaagagucuaaacucaaccgggagaagaucgacggaguuaagcuggaauccaugggcguguaccagauucuggccaucuauagcacggucgcuuccucucucgugcugcuuguuagccugggggccaucuccuucuggaugugcucuaauggaagccuccagugucgcauuugcaucuga

SEQ ID NO: 191838 - RNA, 1701 nt, Artificial Sequence; identical to SEQ ID NO: 185693
  derived and/or modified sequence opt5 from hemagglutinin__InfluenzaA__AFJ76203

SEQ ID NO: 191839 - RNA, 1701 nt, Artificial Sequence
  derived and/or modified sequence opt5 from hemagglutinin__InfluenzaA__AFJ76213
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacauucuaaauauaaguacccugcccugaaugucaccaugcccaacaaugagaaauuugauaagcuguauaucuggggagugcaccauccugggacggacuccgaucagauuagccuguacgcgcaggccuccggccgcaucacaguuucuaccaaaagaagccaacagacagugauuccgaacaucgggucccggccccgcgucagagacgugagcucucggauuuccaucuacuggaccaucgugaagccuggagacauucuccugaucaacagcaccggcaaucugauugcuccccgcggguauuucaagaucagaucuggaaaaagcuccauuaugcggucugaugccccuaucggcaaguguaacagcgagugcaucacacccaauggcuccauuccgaacgacaaaccuuuucagaaugucaaccgcaucacguacggggcuugucccagauauguuaagcagaauacccucaaacuggccacaggaaugcggaacgugccugaaaagcaaacccgcggcauuuucggggcgaucgccggauuuauugagaauggcugggaagggaugguggauggaugguacggcuucagacaccagaacagcgagggcacagggcaggcugccgaccuuaaaucuacccaagcugccaucaaucagaucaacggaaagcugaaucggcucauuggcaagacgaacgagaaauuucaccagaucgaaaaggaguucuccgaagucgaggggcgcauucaggaucuggaaaaauauguggaggacacaaagaucgaucuuuggagcuacaaugccgagcugcucguugcucuggaaaaccaacauaccauugaccugaccgauucugagaugaacaaacucuucgaaagaacaaagaagcagcugcgggagaaugcggaagacaugggaaacggcugcuuuaaaaucuaucacaagugugauaaugccugcauuggguccaucagaaacggcaccuacgaccaugacguguaccgcgaugaggcucuuaauaaccgguuccagaucaaaggagucgagcuuaagagcggcuauaaagacuggauucucuggaucuccuuugccauuucuugcuuccugcuuuguguggcccugcucggguuuaucaugugggcuugccagaagggaaauauuagauguaacaucugcaucuga

SEQ ID NO: 191840 - RNA, 1701 nt, Artificial Sequence
  derived and/or modified sequence opt5 from hemagglutinin__InfluenzaA__AFJ77408
augaagaccaucauugcccugagcuacauccucugccugauuuucgcucagaaacuucccggcaacgacaauuccacagccacgcugugucucgggcaccaugcggugccuaacggaacccuggucaagacaaucaccaaugaucaaauugagguuacaaacgcuaccgaacuugugcagucuagcuccacaggcagaaucugcaauucuccgcaccggauccuggacggggagaacuguacccucauugaugcccugcugggagacccccauugcgauggcuuucagaauaaagaaugggaccucuucguggagcgcagcaaggccuauuccaacuguuacccuuaugauguccccgacuacgcuucucugagaagccuuguggccuccagcgggacgcuggaauuuaccaaagagggauucaauuggacaggcguugcucaggauggcaagucuuauuccugcaagcgggggagcgugaacuccuuuuucucucgccucaauuggcugcacaaacuugaguacaaguauccugcccugaacgucaccaugcccaauaacgacaaauuugauaagcucuacaucuggggagugcaucacccuagcacagacucugaucaaaccucccuguacguucaggcgagcggcagagugacggucuccacaaaacggucucagcagaccgugauuccgaauaucgggagccgccccugggugagaggaauuuccagccggaucucuauuuauuggacaaucgucaagccuggcgacauccugcucauuaacuccaccgggaaccugaucgcuccccgcggauacuucaagauuagaaauggcaaaagcucuaucaugcggagcgacgccccuauuggcaacuguaauuccgaaugcaucacccccaacgggucuaucccgaaugauaagccuuuucaaaacguuaaucgcauuacauauggagccugucccagauacgugaaacagaacacgcuuaagcuggcuaccggcaugcggaaugugccugagaaacagacacgcgggaucuucggagccauugcgggcuuuaucgaaaacgggugggagggaauggucgacggcugguauggcuucagacaccagaauagcgaggggaccggacaagccgcugaucucaaguccacacaggccgcuauuaaccagaucaauggcaaacugaaccggcuuaucgaaaagaccaaugagaaguuucaucaaauugaaaaagaguucagcgaaguggaggggagaauccaggaccuggagaaguacguugaagauacgaaaauugaccucuggucuuauaacgccgagcugcugguggcccucgaaaaccagcacacaaucgaucugaccgacuccgagaugaauaaacuuuucgaacgcacccggaagcagcugagagagaacgcugaggauaugggaaauggcugcuuuaagauuuaccauaagugugacaacgcgugcaucgggagcauucgcaauggcacauacgaucacgacgucuaucgggacgaagcccucaacaauagauuccaaaucaaaggaguggagcugaagucuggcuacaaagauuggauccuuuggauuuccuuugcuaucagcugcuuccugcucuguguugugcugcugggguuuauuaugugggccugccagaagggaaacauccgcuguaauauuugcaucuga

SEQ ID NO: 191841 - RNA, 1701 nt, Artificial Sequence
  derived and/or modified sequence opt5 from hemagglutinin__InfluenzaA__AFJ77430
augaagaccaucauugcccugagcuacauccucugccugauuuucgcucagaaacuucccggcaacgacaauuccacagccacgcugugucucgggcaccaugcggugccuaacggaacccuggucaagacaaucaccaaugaucaaauugagguuacaaacgcuaccgaacuugugcagucuagcuccacaggcagaaucugcgacucuccgcaccggauccuggauggggagaauuguacccucauugacgcccugcugggagaucccaacugcgacggcuuucagaauaaagaaugggaucucuucguggagcgcagcaaggccuauuccaacuguuacccuuaugacguccccgauuacgcuucucugagaagccuuguggccuccagcgggacgcuggaauuuaccaaagagggauucaauuggacaggcguugcucaggacggcaagucuuauuccugcaagcgggggagcgugaacuccuuuuucucucgccucaauuggcugcauaaacuugaguacaaguauccugcccugaacgucaccaugcccaauaacgauaaauuugacaagcucuacaucuggggagugcaccauccuagcacagauucugaccaaauuucccuguacgcgcaggccagcggcagaguuaccguguccacgaaacggucucagcagacagucaucccgaauauugggagccgccccugggugagaggaaucuccagccggauuucuaucuauuggaccaucgugaagccuggcgacauucugcucaucaacuccacagggaaccugauugcuccccgcggauacuucaagaucagaaauggcaaaagcucuauuaugcggagcgaugccccuaucggcaacuguaauuccgaaugcaucacccccaacgggucuauuccgaaugacaagccuuuucaaaacgucaaucgcaucaccuauggagcuugucccagauacguuaaacagaacacacuuaagcuggccacgggcaugcggaaugugccugagaaacagacccgcgggauuuucggagcgaucgccggcuuuauugaaaacgggugggagggaaugguggauggcugguauggcuucagacaccagaauagcgaggggacaggacaagcugccgaccucaaguccacccaggcugccaucaaccagaucaauggcaaacugaaccggcuuauugaaaagacaaaugagaaguuucaccaaaucgaaaaagaguucagcgaagucgaggggcgcauucaggaucuggagaaguacguggaagacaccaaaaucgaucucuggucuuauaacgccgagcugcugguugcucucgaaaaccagcauacgauugaccugacagauuccgagaugaauaaacuuuucgaaagaacccggagacagcugcgcgagaacgcggaggacaugggaaauggcugcuuuaagaucuaccacaagugugauaacgccugcauugggagcauccggaauggcaccuacgaccaugacguguauagagaugaagcucucaacaaucgcuuccaaaucaagggagucgagcugaaaucuggcuacaaggacuggauucuuuggaucuccuuugccauuagcugcuuccugcucugugugguucugcugggguuuaucaugugggccugccagaaaggaaacauucgguguaauaucugcaucuga

SEQ ID NO: 191842 - RNA, 1701 nt, Artificial Sequence
  derived and/or modified sequence opt5 from hemagglutinin__InfluenzaA__AFJ77440
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccucugaaggauucaacuggacaggcguggcucaggacggcaccuccuaugccugcaagcgggggagcgucaagucuuucuucucccgccucaauuggcugcacaaacuugaguacaaguauccugcgcugaacgugacaaugcccaauaacgauaaauuugacaagcucuacauuuggggaguucaucacccuagcaccgauucugaccaaacgucccuguacgugcaggccagcggcagagucacaguguccaccaaacggucucagcagacagugaucccgaauauugggagccgccccugggucagaggaguuuccagccggaucucuauuuauuggaccaucgugaagccuggcgacauucugcucaucaacuccaccgggaaucugaucgcuccccgcggauacuucaagauuagaagcggcaaaucuagcaucaugcgguccgaugccccuauuggcaacuguaacucugagugcaucacacccaaugggagcauuccgaacgacaagccuuuucaaaaugugaaccgcaucacguauggagcuugucccagauacgucaaacagaauacccuuaagcuggccacaggcaugcggaacgugccugaaaaacagacccgcgggaucuucggagcgauugccggcuuuaucgagaaugggugggaaggaaugguugauggcugguauggcuucagacaccagaacuccgaggggacaggacaagcugccgaccucaagagcacccaggcugccauuaaucagaucaacggcaaacugaaucggcuuauugagaagacgaacgaaaaguuucaucaaaucgagaaagaauuuucugagguggaagggagaauccaggaucuggagaaguacgucgaggacacaaaaauugaucucugguccuauaaugccgaacugcugguggcucucgagaaccagcacaccaucgaccugaccgauagcgaaaugaauaaacuuuucgagcgcacacggaagcagcugagagaaaacgcggaggacaugggaaacggcugcuuuaagauuuaccauaagugugauaaugccugcaucgggucuauucgcaacggcaccuacgaccacgacguuuaucgggaugaggcucucaauaacagauuccaaaucaaaggaguggaacugaaguccggcuacaaagacuggauucuuuggaucagcuuugccaucuccugcuuccugcucugugucgugcugcugggguuuauuaugugggccugccagaagggaaauauccgcuguaacauuugcaucuga

SEQ ID NO: 191843 - RNA, 1701 nt, Artificial Sequence
  derived and/or modified sequence opt5 from hemagglutinin__InfluenzaA__AFJ77451
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaaguccuuuuucucuagacucaacuggcugcacaaacuugaguacaaguauccugcgcugaaugugaccaugcccaacaaugacaaauuugauaagcucuacauuuggggcguucaucacccuagcacagacucugaucaaaccucccuguacgugcaggccagcgggcgggucacgguguccacaaaacgcucucagcagaccgugaucccgaacauuggaagcagacccuggguccggggcguuuccagccgcaucucuauuuauuggacaaucgugaagccuggggacauucugcucaucaacuccaccggaaaucugaucgcucccagaggcuacuucaagauucggagcgggaaaucuagcaucaugcgcuccgacgccccuauuggaaacuguaauucugagugcaucacccccaacggcagcauuccgaaugauaagccuuuucaaaacgugaauagaaucacauauggcgcuuguccccgguacgucaaacagaacacgcuuaagcuggccaccgggaugcgcaaugugccugaaaaacagacaagaggaaucuucggcgcgauugccggguuuaucgagaacggaugggaaggcaugguugacgggugguauggauuccggcaccaaaauuccgagggcaccggccaggcugccgaucucaagagcacacaggcugccauuaaccagaucaaugggaaacugaacagacuuauugagaagaccaauggaaaguuucaucaaaucgaaaaagaguucucugaaguggagggccgcauccaggaccuggaaaaguacgucgaggauacgaaaauugaccucugguccuauaacgccgagcugcugguggcucucgaaaaccagcacacaaucgaucugaccgacagcgagaugaauaaacuuuucgaacggaccagaaagcagcugcgcgagaacgcggaagauauggggaauggaugcuuuaagauuuaccauaagugugacaacgccugcaucggcucuauucggaaugggacauacgaucacgacguuuauagagacgaggcucucaacaaucgcuuccaaaucaaaggcguggagcugaaguccggauacaaagauuggauucuuuggaucagcuuugccaucuccugcuuccugcucugugucgugcugcugggcuuuauuaugugggccugccagaaggggaacauccgguguaauauuugcaucuga

SEQ ID NO: 191844 - RNA, 1701 nt, Artificial Sequence
  derived and/or modified sequence opt5 from hemagglutinin__InfluenzaA__AFJ77462
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaguuagcucccggaucagcauuuauuggaccaucgugaagccuggcgacauucugcucaucaauucuaccgggaaccugaucgcuccccgcggauacuucaagauuagauccggcaaaagcucuaucaugcggagcgaugccccuauuggcaacuguaauuccgagugcaucacacccaacgggucuauuccgaaugacaagccuuuucaaaacgugaaucgcaucacguauggagcuugucccagauacgucaaacagaacacccuuaagcuggccacaggcaugcggaaugugccugaaaaacagacccgcgggaucuucggagcgauugccggcuuuaucgagaacgggugggaaggaaugguugauggcugguauggcuucagacaccagaauagcgaggggacaggacaagcugccgaccucaaguccacccaggcugccauuaaccagaucaauggcaaacugaaccggcuuauugagaagacgaaugaaaaguuucaucaaaucgagaaagaguucagcgaaguggaagggagaauccaggaucuggagaaguacgucgaggacacaaaaauugaucucuggucuuauaacgccgaacugcugguggcucucgagaaucagcacaccaucgaccugaccgauuccgaaaugaacaaacuuuucgagcgcacacggaagcagcugagagaaaacgcggaggacaugggaaauggcugcuuuaagauuuaccauaagugugauaacgccugcaucgggagcauucgcaauggcaccuacgaccacgacguuuaucgggaugaggcucucaacaauagauuccaaaucaaaggaguggaacugaagucuggcuacaaagacuggauucuuuggaucuccuuugccaucagcugcuuccugcucugugucgugcugcugggguuuauuaugugggccugccagaagggaaacauccgcuguaauauuugcaucuga

SEQ ID NO: 191845 - RNA, 1701 nt, Artificial Sequence
  derived and/or modified sequence opt5 from hemagglutinin__InfluenzaA__AFJ77473
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccagauccuugauggggagaauuguacccugaucgacgcccuccugggagauccccauugcgacggcuuucaaaacaaagaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggaguggcucagaauggcacauccagcgccugcaaaagacggucuauuaaguccuuuuucagccgccugaacuggcuccaccagcugaaguauaaauacccugcgcuuaaugucaccaugcccaacaaugagaaguuugacaaacuguauaucuggggcgugcaucacccuucuacagauuccgaccagauuagccucuacgcccaagccuccgggagaguuaccgugucuacgaagcggagccagcagacagucaucccgaacauuggaucccgccccugggugagaggcgugagcucucggaucuccauuuacuggaccaucgucaaaccuggggauauccugcugauuaacagcacaggaaaucucaucgcuccccgcggcuauuucaagauuagaucuggaaagagcuccaucaugcggucugacgcuccuauugggaaauguaacagcgaaugcaucacccccaauggcuccaucccgaacgacaagccuuuucagaauguuaaccgcauuaccuacggcgccugucccagauaugugaaacaaaauacacugaaacuugcgacggggaugcggaacgugccugagaagcagacccgcggaaucuucggcgccauugcuggguuuaucgaaaauggaugggagggcauggucgaugggugguacggauucagacaccagaacagcgagggcacaggccaagccgcugaccugaagucuacccaggccgccauuaaucagaucaacgggaaacucaaucggcugaucgaaaagacaaacgagaaguuucaucagauugaaaaagaguucuccgaaguggagggaagaauccaagaucuugagaaguauguugaagacaccaaaauugaucuguggagcuacaaugcugagcuccugguggcgcuggaaaaccagcacacgaucgaccucacagauucugagaugaacaagcuguucgaacgcaccaaaaagcagcuucgggagaaugccgaggacaugggcaacgggugcuuuaagauuuaucauaaaugugauaaugcuugcaucggauccauuagaaacggcaccuacgaccacgaugucuaccgcgacgaagcccugaauaaccgguuccagaucaaggggguggagcucaaaagcggcuauaaggacuggauccuguggauuuccuuugccaucucuugcuuccuucuguguguugugcuccugggauuuauuaugugggcuugccaaaaaggcaauaucagauguaacauuugcaucuga

SEQ ID NO: 191846 - RNA, 1701 nt, Artificial Sequence; identical to SEQ ID NO: 183210
  derived and/or modified sequence opt5 from hemagglutinin__InfluenzaA__AFJ77484

SEQ ID NO: 191847 - RNA, 1701 nt, Artificial Sequence; identical to SEQ ID NO: 183212
  derived and/or modified sequence opt5 from hemagglutinin__InfluenzaA__AFJ77495

SEQ ID NO: 191848 - RNA, 1701 nt, Artificial Sequence; identical to SEQ ID NO: 183210
  derived and/or modified sequence opt5 from hemagglutinin__InfluenzaA__AFJ77506

SEQ ID NO: 191849 - RNA, 1701 nt, Artificial Sequence
  derived and/or modified sequence opt5 from hemagglutinin__InfluenzaA__AFJ77517
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccaacgccugcaaacggcgcagcaugaagucuuucuucuccagacugaauuggcuccaccaacugaaguauaaauacccugcgcuuaacgucaccaugcccaauaacgacaaguuugauaaacuguauaucuggggcgugcaucacccuagcacagacucugaucagaccucccucuacgcccaggcuagcgggcggguuacgguguccacacagcgcucucaacagaccgucauuccgaacaucggaagcagacccugggugcggggcguguccagccgcauuucuaucuacuggacaauugucaagccuggggacauccugcugaucaauuccaccggaaaccucauugcccccagaggcuauuucaaaauccggagcgggaagucuagcauuauccgcuccgacgcuccuauuggaaaguguaauucugagugcaucacccccaacggcagcaucccgaaugauaaaccuuuucagaacguuaauagaauuacauacggcgccuguccccgguaugugaagcagaacacgcugaaacuugcgaccgggaugcgcaaugugccugaaaagcaaacaagaggaaucuucggcgccauugcuggguuuaucgagaacggaugggaaggcauggucgacgggugguacggauuccggcaccaaaauuccgagggcaccggccaggccgcugaucugaaaagcacacaggccgccauuaaccagaucaaugggaagcucaacagacugaucgagaaaaccaaugaaaaguuucaucagauugagaaggaauuuucugagguggaaggacgcauccaggaccuugagaaauauguugaggauacgaagauugaccugugguccuacaacgcugaacuccugguggcgcuggagaaccaacacacaaucgaucucaccgacagcgaaaugaauaaacuguucgagcggaccagaaagcagcuucgcgaaaacgccgaggauaugggcaaugggugcuuuaaaauuuaucauaagugugacaacgcuugcaucggaucuauucggaauggcacauacgaucacgacgucuacagagacgaggcccugaacaaucgcuuccagaucaaggggguggaacucaaauccggcuauaaggauuggauccuguggauuagcuuugccauguccugcuuccuucuguguguugugcuccugggauuuaucaugugggcuugccagaaaggcaacauucgguguaauaucugcauuuga

SEQ ID NO: 191850 - RNA, 1701 nt, Artificial Sequence; identical to SEQ ID NO: 183047
  derived and/or modified sequence opt5 from hemagglutinin__InfluenzaA__AFJ77528

SEQ ID NO: 191851 - RNA, 1698 nt, Artificial Sequence
  derived and/or modified sequence opt5 from hemagglutinin__InfluenzaA__AFJ77550
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccagauccuugauggggagaauuguacccugaucgacgcccuccugggagauccccauugcgacggcuuucaaaacaaagaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggaguggcucagaauggcacauccagcgccugcaaaagacggucuauuaaguccuuuuucagccgccugaacuggcuccaccagcugaaguauaaauacccugcgcuuaaugucaccaugcccaacaaugagaaguuugacaaacuguauaucuggggcgugcaucacccuucuacagauuccgaccagauuagccucuacgcccaagccuccgggagaguuaccgugucuacgaagcggagccagcagacagucaucccgaacauuggaucccgccccugggugagaggcgugagcucucggaucuccauuuacuggaccaucgucaaaccuggggauauccugcugauuaacagcacaggaaaucucaucgcuccccgcggcuauuucaagauuagaucuggaaagagcuccaucaugcggucugacgcuccuauugggaaauguaacagcgaaugcaucacccccaauggcuccaucccgaacgacaagccuuuucagaauguuaaccgcauuaccuacggcgccugucccagauaugugaaacaaaauacacugaaacuugcgacggggaugcggaacgugccugagaagacccgcggaaucuucggcgccauugcuggguuuaucgaaaauggaugggagggcauggucgaugggugguacggauucagacaccagaacagcgagggcacaggccaggccgcugaccugaagucuacccaagccgccauuaaucagaucaacgggaaacucaaucggcugaucgaaaagacaaacgagaaguuucaucagauugaaaaagaguucuccgaaguggagggaagaauccaggaucuugagaaguauguugaagacaccaaaauugaucuguggagcuacaaugcugagcuccugguggcgcuggaaaaccaacacacgaucgaccucacagauucugagaugaacaagcuguucgaacgcaccaaaaagcagcuucgggagaaugccgaggacaugggcaacgggugcuuuaagauuuaucauaaaugugauaaugcuugcaucggauccauuagaaacggcaccuacgaccacgaugucuaccgcgacgaagcccugaauaaccgguuccagaucaaggggguggagcucaaaagcggcuauaaggacuggauccuguggauuuccuuugccaucucuugcuuccuucuguguguugugcuccugggauuuauuaugugggcuugccagaaaggcaauaucagauguagcauuugcaucuga

SEQ ID NO: 191852 - RNA, 1701 nt, Artificial Sequence
  derived and/or modified sequence opt5 from hemagglutinin__InfluenzaA__AFJ77561
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaagucuuucuucuccagacucaacuggcugcacaaacuugaguacaaguauccugcgcugaaugugaccaugcccaacaaugacaaauuugauaagcucuacauuuggggcguucaucacccuagcacagacucugaucaaaccucccuguacgcccaggcuagcgggcgggugacggucuccacaaaacgcucucagcagaccgugaucccgaacauuggaagcagacccugggugcggggcgucuccagccgcaucucuauuuauuggacaaucguuaagccuggggacauucugcucaucuacuccaccggaaaccugaucgcccccagaggcuauuucaagauucggagcgggaaaucuagcaucaugcgcuccgacgcuccuauuggaaauuguucuagcgagugcaucacccccaacggcuccauuccgaaugauaagccuuuucaaaacgugaauagaaucacauacggcgccuguccccgguaugugaaacagaacacgcuuaagcuggcgaccgggaugcgcaaugucccugaaaaacagacaagaggaaucuucggcgccauugcuggguuuaucgagaacggaugggaaggcaugguggacgggugguacggauuccggcaccagaauagcgagggcaccggccaagccgcugaucucaagucuacacaggccgccauuaaccagaucaaugggaaacugaacagacuuauugagaagaccaaugaaaaguuucaucaaaucgagaaagaauuuuccgagguugaaggacgcauccaggaccuggagaaguauguggaggauacgaaaauugaccucuggagcuacaacgcugaacugcuggucgcgcucgagaaucagcacacaaucgaucugaccgacucugaaaugaacaagcuguucgagcggaccagaaaacagcugcgcgaaaacgccgaggauaugggcaaugggugcuuuaagauuuaccauaagugugacaacgcuugcaucggauccauucggaauggcacauaugaucacgacguguacagagacgaggcccucaacaaucgcuuccaaaucaaagggguugaacuuaagagcggcuauaaagauuggauucuuuggaucuccuuugccaucucuugcuuccugcucugugugguccugcugggauuuauuaugugggcuugccagaagggcaacauccgguguaauauuugcaucuga

SEQ ID NO: 191853 - RNA, 1698 nt, Artificial Sequence
  derived and/or modified sequence opt5 from hemagglutinin__InfluenzaA__AFJ77572
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccagauccuugauggggagaauuguacccugaucgacgcccuccugggagauccccauugcgacggcuuucaaaacaaagaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggaguggcucagaauggcacauccagcgccugcaaaagacggucuauuaaguccuuuuucagccgccugaacuggcuccaccagcugaaguauaaauacccugcgcuuaaugucaccaugcccaacaaugagaaguuugacaaacuguauaucuggggcgugcaucacccuucuacagauuccgaccagauuagccucuacgcccaagccuccgggagaguuaccgugucuacgaagcggagccagcagacagucaucccgaacauuggauccggccccugggugcgcggggugagcucuagaaucuccauuuacuggaccaucgucaaaccuggagauauccugcugauuaacagcacaggcaaucucaucgcuccccggggguauuucaagauucgcucuggaaagagcuccaucaugagaucugacgcuccuauuggcaaauguaacagcgaaugcaucacccccaauggcuccaucccgaacgacaagccuuuucagaauguuaaccggauuaccuacggggccuguccccgcuaugugaaacaaaauacacugaaacuugcgacgggaaugagaaacgugccugagaagacccggggcaucuucggggccauugcuggauuuaucgaaaauggcugggaggggauggucgauggaugguacggcuuccgccaccagaacagcgagggcacagggcaggccgcugaccugaagucuacccaagccgccauuaaucagaucaacggaaaacucaauagacugaucgaaaagacaaacgagaaguuucaucagauugaaaaagaguucuccgaaguggagggccggauccaggaucuugagaaguauguugaagacaccaaaauugaucuguggagcuacaaugcugagcuccugguggcgcuggaaaaccaacacacgaucgaccucacagauucugagaugaacaagcuguucgaaagaaccaaaaagcagcuucgcgagaaugccgaggacauggggaacggaugcuuuaagauuuaucauaaaugugauaaugcuugcaucggcuccauucggaacgggaccuacgaccacgaugucuacagagacgaagcccugaauaaccgcuuccagaucaagggcguggagcucaaaagcggauauaaggacuggauccuguggauuuccuuugccaucucuugcuuccuucuguguguugugcuccugggcuuuauuaugugggcuugccagaaagggaauauccgguguagcauuugcaucuga

SEQ ID NO: 191854 - RNA, 1701 nt, Artificial Sequence
  derived and/or modified sequence opt5 from hemagglutinin__InfluenzaA__AFJ77583
augaagaccaucauuacacugagcuacauccucugccugguguucgcccagaaacuucccgucaaggacaacuccacggcuacccugugucucggccaccaugccguuccuaaugggacacuggugaaaaccauuacaaacgaucacaucgaggugaccaaugcgacagaacuuguccaaucuagcuccaccggaagaauuugcgacucuccgcaucagauccuggauggcgagaacuguacgcucaucgacgcucugcugggggauccccacugcgacggauuucagaauaaggaaugggaucucuucguggagcggagcaccgccuauuccaacuguuacccuuaugacguucccgauuacgccucucugcgcagccuuguggcuuccagcggcacacuggaauuuaauaacgagucuuucaauuggaccggggucgcccagaacggaacauccagcgcuugcaaaagacggucuauuaaguccuuuuucagccgccucaauuggcugcaucaacuuaaguauaaauacccugcccugaacgugaccaugcccaauaacgagaaguuugacaaacucuauaucuggggcguucaccacccuucuacggauuccgaccagauuagccuguacgcgcaggccuccggcagagugacagucucuaccaagcggagccagcaaacagugaucccgaauauugggucccgccccugggugagaggagucagcucucggaucuccauuuacuggaccaucguuaaaccuggcgauauccugcucauuaacagcaccgggaaccugaucgcuccccgcggauauuucaagauuagaucuggcaagagcuccaucaugcggucuaaugccccuauugggaaauguaacagcgaaugcaucacacccaauggauccaucccgaacgacaagccuuuucagaaugugaaccgcauuacguacggcgcuugucccagauaugugaaacagaauacccuuaagcuggccacaggcaugcggaacgucccugagaaacagacccgcgggaucuucggagcgauugccggcuuuaucgaaaaugggugggagggaaugguggacggcugguacggguucagacaucaaaacagcgagggaacaggccaggcugccgaucucaagucuacccaggcugccauuaaucaaaucaacggcaaacugaaucggcuuaucgaaaagacgaacgagaaguuucaccagauugaaaaagaguucuccgaaguugaggggagaauccaggaccuggagaaguauguggaagauacaaaaauugaccucuggagcuacaaugccgagcugcuggucgcucucgaaaaccagcauaccaucgaucugaccgacucugagaugaacaagcuguucgaacgcacacggaaacaacugagagagaaugcggaggauaugggaaacggcugcuuuaagauuuaucacaagugugacaaugccugcaucggguccauucgcaacggaaccuacgaucacgacguguaccgggaugaagcucucaauaacagauuccagaucaaaggcguugagcuuaagagcggguauaaagacuggauccuuuggauuuccuuugccaucucuugcuuccugcucugugugguccugcugggcuuuauuaugugggccugccagaagggaaauauccgcuguaacauuugcaucuga

SEQ ID NO: 191855 - RNA, 1701 nt, Artificial Sequence
  derived and/or modified sequence opt5 from hemagglutinin__InfluenzaA__AFJ77594
augaagaccaucauugcccugagcuacauccucugccugguguucgcucagaaacuucccgucaaggacaacuccacagccacgcugugucucggccaccaugcgguuccuaaugggacccuggugaaaacaauuaccaacgaucacaucgaggugacaaaugcuaccgaacuuguccaaucuagcuccacaggaagaauuugcgacucuccgcaucagauccuggauggcgagaacuguacccucaucgacgcccugcugggggauccccacugcgacggauuucagaauaaggaaugggaucucuucguggagcggagcacggccuauuccaacuguuacccuuaugacguucccgauuacgcuucucugcgcagccuuguggccuccagcggcacccuggaauuuaauaacgagucuuucaauuggacaggggucgcucagaacggaaccuccagcgccugcaaaagacggucuauuaaguccuuuuucagccgccucaauuggcugcaucaacuuaaguauaaauacccugcgcugaacgugacaaugcccaauaacgagaaguuugacaaacucuauaucuggggcguucaccacccuucuaccgauuccgaccagauuagccuguacgcccaggcuuccggcagagugacggucucuacaaagcggagccagcaaaccgugaucccgaauauugggucccgccccugggugagaggagucagcucucggaucuccauuuacuggacaaucguuaaaccuggcgauauccugcucauuaacagcaccgggaaccugaucgcuccccgcggauauuucaagauuagaucuggcaagagcuccaucaugcggucuaaugccccuauugggaaauguaacagcgaaugcaucacccccaauggauccaucccgaacgacaagccuuuucagaaugugaaccgcauuacauacggcgccugucccagauaugugaaacagaauacgcuuaagcuggcgaccggcaugcggaacgucccugagaaacagacacgcgggaucuucggagccauugcuggcuuuaucgaaaaugggugggagggaaugguggacggcugguacggguucagacaucaaaacagcgagggaaccggccaggccgcugaucucaagucuacacaggccgccauuaaucaaaucaacggcaaacugaaucggcuuaucgaaaagaccaacgagaaguuucaccagauugaaaaagaguucuccgaaguugaggggagaauccaggaccuggagaaguauguggaagauacgaaaauugaccucuggagcuacaaugcugagcugcuggucgcgcucgaaaaccagcauacaaucgaucugaccgacucugagaugaacaagcuguucgaacgcacccggaaacaacugagagagaaugccgaggauaugggaaacggcugcuuuaagauuuaucacaagugugacaaugcuugcaucggguccauucgcaacggaacauacgaucacgacguguaccgggaugaagcccucaauaacagauuccagaucaaaggcguugagcuuaagagcggguauaaagacuggauccuuuggauuuccuuugccaucucuugcuuccugcucugugugguccugcugggcuuuauuaugugggcuugccagaagggaaauauccgcuguaacauuugcaucuga

SEQ ID NO: 191856 - RNA, 1701 nt, Artificial Sequence
  derived and/or modified sequence opt5 from hemagglutinin__InfluenzaA__AFJ77605
augaagaccaucauugcccugagcuacauccucugccugauuuucgcucagaaacuucccggcaacgacaauuccacagccacgcugugucucgggcaccaugcggugccuaacggaacccuggucaagacaaucaccaaugaucaaauugagguuacaaacgcuaccgaacuugugcagucuagcuccacaggcaaaaucugcgacucuccgcaccagauccuggauggggagaauuguacccucauugacgcccugcugggagauccccauugcgacggcuuucagaacaaggaaugggaucucuucguggagagaagcaaagccuauuccaauuguuacccuuaugacguccccgauuacgcuucucugcggagccuuguggccuccagcgggacgcuggaauuuaacaaugagucuuucaacuggaccggaguugcucaaaauggcacauccagcgccugcaagcgcagaucuaacaaguccuuuuucagccggcucaauuggcugcaccagcuuaaauauaaguacccugcgcugaacgugaccaugcccaauaacgagaaauuugacaagcucuauaucuggggcguccaucacccuucuacagauuccgaccagauuagccuguacgcccaggcuuccgggcgcgugaccguuucuacgaaaagaagccaacagacagugaucccgaacauuggaucccggcccuggguccgcggcgugagcucuagaaucuccauuuacuggaccaucgugaagccuggggauauccugcucauuaauagcacaggaaaccugaucgcuccccggggcuauuucaagauucgcucugggaaaagcuccaucaugagaucugacgccccuauuggaaaguguaauagcgaaugcaucacccccaacggcuccaucccgaaugacaaaccuuuucagaacgucaaucggauuaccuacggcgccuguccccgcuauguuaagcagaacacacuuaaacuggcgacggggaugagaaaugugccugagaagcaaacccggggaaucuucggcgccauugcuggguuuaucgaaaacggaugggagggcaugguggaugggugguacggauuccgccaccagaauagcgagggcacaggccaggccgcugaccucaaaucuacccaagccgccauuaaccagaucaaugggaagcugaacagacuuaucgaaaagacaaaugagaaauuucaucagauugaaaaggaguucuccgaagucgagggacggauccaggaucuggagaaauauguggaagacaccaagauugaucucuggagcuacaacgcugagcugcugguugcgcucgaaaaccaacacacgaucgaccugacagauucugagaugaauaaacuuuucgaaagaaccaagaagcagcugcgcgagaacgccgaggacaugggcaaugggugcuuuaaaauuuaucauaagugugauaacgcuugcaucggauccauucggaauggcaccuacgaccacgauguguacagagacgaagccgucaacaaucgcuuccagaucaaagggguggagcucaagagcggcuauaaagacuggauccuguggauuuccuuugccaucucuugcuuccuucuguguguugugcuccugggauuuauuaugugggcuugccagaagggcaacauccgguguaauauuugcaucuga

SEQ ID NO: 191857 - RNA, 1701 nt, Artificial Sequence
  derived and/or modified sequence opt5 from hemagglutinin__InfluenzaA__AFJ77616
augaagaccaucauugcccugagcuacauccucugcauggugcuggcucagaaacuucccgucaaggacaacuccacagccacgcugugucucggccaccaugcgguuccuaaugggacccuggugaaaacaauuaccaacgaucacaucgaggugacaaaugcuaccgaacuuguccaaucuagcuccacaggaagaauuugcgacucuccgcaucagauccuggauggcgagaacuguacccucaucgacgcccugcugggggauccccacugcgacggauuccagaauaaggaaugggaucucuuuguggagcggagcacggccuauuccaacuguuacccuuaugacguucccgauuacgcuucucugcgcagccuuguggccuccagcggcacccuggaguucaauaacgaaucuuuuaauuggacaggggucgcucagaacggaaccuccagcgccugcaaaagacggucuauuaaguccuucuuuagccgccucaauuggcugcaucaacuuaaguauaaauacccugcgcugaacgugacaaugcccaauaacgagaaguucgacaaacucuauaucuggggcguucaccacccuucuaccgauuccgaccagauuagccuguacgcccaggcuuccggcagagugacggucucuacaaagcggagccagcaaaccgugaucccgaauauugggucccgccccugggugagaggagucagcucucggaucuccauuuacuggacaaucguuaaaccuggcgauauccugcucauuaacagcaccgggaaccugaucgcuccccgcggauauuuuaagauuagaucuggcaagagcuccaucaugcggucuaaugccagcauugggaaauguaacuccgaaugcaucaccccuaauggaagcauccccaacgacaagccguuccagaaugugaaccgcauuacauacggcgccuguccuagauaugugaaacagaauacgcuuaagcuggcgaccggcaugcggaacguccccgagaaacagacacgcgggaucuuuggagccauugcuggcuucaucgaaaaugggugggagggaaugguggacggcugguacggguuuagacaucaaaacucugagggaaccggccaggccgcugaucucaaguccacacaggccgccauuaaucaaaucaacggcaaacugaaucggcuuaucgaaaagaccaacgagaaguuccaccagauugaaaaagaguuuagcgaaguugaggggagaauccaggaccuggagaaguauguggaagauacgaaaauugaccucuggucuuacaaugcugagcugcuggucgcgcucgaaaaccagcauacaaucgaucugaccgacuccgagaugaacaaacuuuucgaacgcacccggaagcaacugagagagaaugccgaggauaugggaaacggcugcuucaagauuuaucacaagugugacaaugcuugcaucgggagcauucgcaacggaacauacgaucacgacguguaccgggaugaagcccucaauaacagauuucagaucaaaggcguugagcugaaguccggguauaaagacuggauccuuuggauuucuuucgccaucagcugcuuucugcucugugugguccugcugggcuucauuaugugggcuugccagaagggaaauauccgcuguaacauuugcaucuga

SEQ ID NO: 191858 - RNA, 1701 nt, Artificial Sequence
  derived and/or modified sequence opt5 from hemagglutinin__InfluenzaA__AFJ77627
augaagaccaucauugcccugagcuacauccucugccuggugcuugcucagaaacugcccgucaaggacaacuccacagccacgcucugucugggccaccaugcgguuccuaaugggacccuugugaaaacaauuaccaacgaucacaucgaggugacaaaugcuaccgaacugguccaaucuagcuccacaggaagaauuugcgacucuccgcaucagauccucgauggcgagaacuguacccugaucgacgcccugcucggggauccccacugcgacggauuccagaauaaggaaugggaucuguuuguggagcggagcacggccuauuccaacuguuacccuuaugacguucccgauuacgcuucucuucgcagccugguggccuccagcggcacccucgaguucaauaacgaaucuuuuaauuggacaggggucgcucagaacggaaccuccagcgccugcaaaagacggucuauuaaguccuucuuuagccgccugaauuggcuucaucaacugaaguauaaauacccugcgcucaacgugacaaugcccaauaacgagaaguucgacaaacuguauaucuggggcguucaccacccuucuaccgauuccgaccagauuagccuguacgcccaggcuuccggcagagugacggucucuacaaagcggagccagcaaaccgugaucccgaauauugggucccgccccugggugagaggagucagcucucggaucuccauuuacuggacaaucguuaaaccuggcgauauccuccugauuaacagcaccgggaaccuuaucgcuccccgcggauauuuuaagauuagaucuggcaagagcuccaucaugcggucuaaugccagcauugggaaauguaacuccgaaugcaucaccccuaauggaagcauccccaacgacaagccguuccagaaugugaaccgcauuacauacggcgccuguccuagauaugugaaacagaauacgcugaagcucgcgaccggcaugcggaacguccccgagaaacagacacgcgggaucuuuggagccauugcuggcuucaucgaaaaugggugggagggaaugguggacggcugguacggguuuagacaucaaaacucugagggaaccggccaggccgcugaucugaaguccacacaggccgccauuaaucaaaucaacggcaaacuuaaucggcugaucgaaaagaccaacgagaaguuccaccagauugaaaaagaguuuagcgaaguugaggggagaauccaggaccucgagaaguauguggaagauacgaaaauugaccuguggucuuacaaugcugagcugcucgucgcgcuggaaaaccagcauacaaucgaucuuaccgacuccgagaugaacaagcuguucgaacgcacccggaaacaacucagagagaaugccgaggauaugggaaacggcugcuucaagauuuaucacaagugugacaaugcuugcaucgggagcauucgcaacggaacauacgaucacgacguguaccgggaugaagcccugaauaacagauuucagaucaaaggcguugagcuuaaguccggguauaaagacuggauccuguggauuucuuucgccaucagcugcuuucuccugugugugguccugcucggcuucauuaugugggcuugccagaagggaaauauccgcuguaacauuugcaucuga

SEQ ID NO: 191859 - RNA, 1701 nt, Artificial Sequence
  derived and/or modified sequence opt5 from hemagglutinin__InfluenzaA__AFJ77638
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcuccccgcggcuauuucaagaucagaucuggaaagagcuccauuaugcggucugacgccccuaucgggaaauguaauagcgaaugcaccacccccaacggcuccauuccgaaugacaagccuuuucagaacguuaaucgcaucacauacggcgccugucccagauaugugaaacagaacacgcuuaagcuggcgaccgggaugcggaaugugccugagaaacaaacacgcggaaucuucggcgccauugcuggguuuaucgaaaacggaugggagggcauggucgaugggugguacggauucagacaccagaauagcgagggcaccggccaggccgcugaccucaagucuacacaagccgccauuaaccagaucaaugggaaacugaaccggcuuauuggaaagaccaaugaaaaguuucaucagaucgagaaagaguucuccgaaguggaaggcagaauccaggaucuggagaaguauguugaggacacgaaaauugaucucuggagcuacaacgcugaacugcugguggcgcucgagaaccaacacacaaucgaccugaccgauucugaaaugaauaaacuuuucgagcgcaccaagaagcagcugcgggaaaacgccgaggacauggggaauggaugcuuuaagauuuaucauaaaugugauaacgcuugcaucggcuccauuagaaaugggacauacgaccacgaugucuaccgcgacgaggcccucaacaaucgguuccagaucaagggcguggaacugaaaagcggauauaaggacuggauucuuuggaucuccuuugccaucucuugcuuccugcucuguguugugcugcugggcuuuauuaugugggcuugccagaaagggaacaucagauguaauauuugcaucuga

SEQ ID NO: 191860 - RNA, 1701 nt, Artificial Sequence
  derived and/or modified sequence opt5 from hemagglutinin__InfluenzaA__AFJ77649
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauaacacaggaaaucugauugcccccagaggcuauuucaagaucagaaacggaaagagcucuauuaugcggagcgacgcuccuaucgggaaauguaauuccgaaugcauuacccccaacggcucuaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaaguccacccaagccgccaucaaccagauuaaugggaaacugaaccggcuuaucggaaagacaaacgaaaaguuucaucagaucgagaaagaguucagcgaaguggaaggccgcauucaggaucuggagaaguauguugaggacaccaaaaucgaucucuggucuuacaaugcugaacugcugguggcgcucgagaaccaacacacgauugaccugacagauuccgaaaugaauaaacuuuucgagcgcaccaagaagcagcugcgggaaaacgccgaggacauggggaauggaugcuuuaagaucuaucauaaaugugauaacgcuugcauuggcagcaucagaaaugggaccuacgaccacgaugucuaccgcgacgaggcccucaacaaucgguucaagauuaaaggcguggaacugaagucuggauauaaagacuggauccuuuggaucuccuuugccauuagcugcuuccugcucuguguugugcugcugggcuuuaucaugugggcuugccagaaggggaacauuagauguaauaucugcauuuga

SEQ ID NO: 191861 - RNA, 1701 nt, Artificial Sequence; identical to SEQ ID NO: 183227
  derived and/or modified sequence opt5 from hemagglutinin__InfluenzaA__AFJ77660

SEQ ID NO: 191862 - RNA, 1701 nt, Artificial Sequence; identical to SEQ ID NO: 183227
  derived and/or modified sequence opt5 from hemagglutinin__InfluenzaA__AFJ77671

SEQ ID NO: 191863 - RNA, 1701 nt, Artificial Sequence; identical to SEQ ID NO: 183227
  derived and/or modified sequence opt5 from hemagglutinin__InfluenzaA__AFJ77682

SEQ ID NO: 191864 - RNA, 1701 nt, Artificial Sequence
  derived and/or modified sequence opt5 from hemagglutinin__InfluenzaA__AFJ77693
augaagaccaucauugcccugagcuacauccucugccugguguucgcucagaaacuucccgucaacgacaauuccacagccacgcugugucucggccaccauaccguuccuaacgggacacuggugaagaccauuacaaaugauaacaucgaggugaccaaugcgacagaacuuguccaaucuagcuccaccggaagaauuugcgacucuccgcaccagauccuggauggcgagaacuguacgcucaucgacgcucugcugggggauccccauugcgacggauuucagaauaaagaaugggaucucuucguggagcggagcaccgccuauuccaacuguuacccuuaugacguucccgauuacgccucucugcgcagccuuguggcuuccagcggcacacuggaauuuaauaacgagucuuucaauuggaccggggucgaccagaacggaacauccagcgccugcaagagacggucuaauaaauccuuuuucagccgccucaacuggcugcaccaacuuaaguauaaguacccugcucugaaugugaccaugcccaacaacgagaaauuugauaagcucuauauuuggggcguucaucacccuucuacggacuccgaucagaucagccuguacgcccaggcguccggcagagugacagucucuaccaaacggagccagcaaacagugauuccgaauaucgggucccgccccugggugagaggagucagcucucggauuuccaucuacuggaccauuguuaagccuggcgacauccugcucaucaacagcaccgggaaucugauugcccccagaggauauuucaaaaucagaucuggcaagagcuccauuaugcggucuaacgcuccuaucgggaaguguaauagcgaaugcauuacacccaacggauccaucccgaaugacaaaccuuuucagaacgugaaucgcaucacguacggcgccugucccagauaugugaagcagaacacccuuaaacuggcuacaggcaugcggaaugucccugagaagcagacccgcgggauuuucggagccaucgcgggcuuuauugaaaacgggugggagggaaugguggauggcugguacggguucagacaccaaaauuuugagggaacaggccaggccgcugaccucaaaagcacccaggccgcuaucaaccaaauuaauggcaagcugaaccggcuuaucgagaaaacgaacgaaaaguuccaucagaucgaaaaggaguucucugaaguugaggggcgcauucaggaucuggagaaauauguggaagacacaaagaucgaucucugguccuacaaugccgagcugcuggucgcccucgaaaaccagcacaccauugaccugaccgauagcgagaugaauaaacuuuuugaacgcacacggaagcaacugagagagaacgcugaggacaugggaaauggcugcuucaaaaucuaucauaagugugauaacgcgugcauugggucuauccgcaauggaaccuacgaccacgauguguaccgggacgaagcccucaacaauagauuucagauuaagggcguugagcugaaauccggguauaaggacuggauccuuuggaucagcuucgcuauuuccugcuuucugcucugugugguccugcugggcuucaucaugugggccugccagaaaggaaacauucgcuguaauaucugcauuuga

SEQ ID NO: 191865 - RNA, 1701 nt, Artificial Sequence; identical to SEQ ID NO: 183227
  derived and/or modified sequence opt5 from hemagglutinin__InfluenzaA__AFJ77704

SEQ ID NO: 191866 - RNA, 1701 nt, Artificial Sequence; identical to SEQ ID NO: 191705
  derived and/or modified sequence opt5 from hemagglutinin__InfluenzaA__AFJ77715

SEQ ID NO: 191867 - RNA, 1701 nt, Artificial Sequence; identical to SEQ ID NO: 191705
  derived and/or modified sequence opt5 from hemagglutinin__InfluenzaA__AFJ77726

SEQ ID NO: 191868 - RNA, 1701 nt, Artificial Sequence; identical to SEQ ID NO: 191801
  derived and/or modified sequence opt5 from hemagglutinin__InfluenzaA__AFJ77737

SEQ ID NO: 191869 - RNA, 1701 nt, Artificial Sequence; identical to SEQ ID NO: 183056
  derived and/or modified sequence opt5 from hemagglutinin__InfluenzaA__AFJ77748

SEQ ID NO: 191870 - RNA, 1701 nt, Artificial Sequence; identical to SEQ ID NO: 183056
  derived and/or modified sequence opt5 from hemagglutinin__InfluenzaA__AFJ77759

SEQ ID NO: 191871 - RNA, 1701 nt, Artificial Sequence
  derived and/or modified sequence opt5 from hemagglutinin__InfluenzaA__AFJ77781
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacucugaauccuucgacuggaccggcgugacacagaauggcaccagcucugcuugcaagcgcagauccaacaagagcuuuuucucucggcugaauuggcucacacaucugaaauauaaguacccugcccuuaacgucaccaugcccaauaacgagaaauuugauaagcuguauaucuggggagugcaccauccugggacggacuccgaucagauuagccucuacgcgcaggccuccggccgcaucacaguuucuaccaaaagaagccaacagacagugauuccgaauaucgggucccggccccgcgucagagacgugagcucucggauuuccaucuacuggaccaucgugaagccuggagacauucugcugaucaacagcaccggcaaccucauugcuccccgcggguauuucaagaucagaucuggaaaaagcuccauuaugcggucugaugccccuaucggcaaguguaauagcgagugcaucacacccaacggcuccauuccgaaugacaaaccuuuucagaacgucaaucgcaucacguacggggcuugucccagauauguuaagcagaacacccugaaacuugccacaggaaugcggaaugugccugaaaagcaaacccgcggcauuuucggggcgaucgccggauuuauugagaacggcugggaagggaugguggauggaugguacggcuucagacaccagaauagcgagggcacagggcaggcugccgaccugaaaucuacccaagcugccaucaaccagaucaauggaaagcucaaccggcugauuggcaagacgaaugagaaauuucaccagaucgaaaaggaguucuccgaagucgaggggcgcauucaggaucuugaaaaauauguggaggacacaaagaucgaucuguggagcuacaacgccgagcuccugguugcucuggaaaaucaacauaccauugaccucaccgauucugagaugaacaaacuguucgaaagaacaaagaagcagcuucgggagaacgcggaagacaugggaaauggcugcuuuaaaaucuaucacaagugugauaacgccugcauuggguccaucagaaauggcaccuacgaccaugacguguaccgcgaugaggcucugaacaaucgguuccagaucaaaggagucgagcucaagagcggcuauaaagacuggauucuguggaucuccuuugccauuucuugcuuccuucuguguguggcccuccugggguuuaucaugugggcuugccagaagggaaacauuagauguaauaucugcaucuga

SEQ ID NO: 191872 - RNA, 1701 nt, Artificial Sequence; identical to SEQ ID NO: 184819
  derived and/or modified sequence opt5 from hemagglutinin__InfluenzaA__AFJ77792

SEQ ID NO: 191873 - RNA, 1701 nt, Artificial Sequence; identical to SEQ ID NO: 184819
  derived and/or modified sequence opt5 from hemagglutinin__InfluenzaA__AFJ77803

SEQ ID NO: 191874 - RNA, 1701 nt, Artificial Sequence; identical to SEQ ID NO: 184819
  derived and/or modified sequence opt5 from hemagglutinin__InfluenzaA__AFJ77814

SEQ ID NO: 191875 - RNA, 1701 nt, Artificial Sequence; identical to SEQ ID NO: 184819
  derived and/or modified sequence opt5 from hemagglutinin__InfluenzaA__AFJ77825

SEQ ID NO: 191876 - RNA, 1701 nt, Artificial Sequence; identical to SEQ ID NO: 184819
  derived and/or modified sequence opt5 from hemagglutinin__InfluenzaA__AFJ77836

SEQ ID NO: 191877 - RNA, 1701 nt, Artificial Sequence; identical to SEQ ID NO: 184819
  derived and/or modified sequence opt5 from hemagglutinin__InfluenzaA__AFJ77847

SEQ ID NO: 191878 - RNA, 1701 nt, Artificial Sequence
  derived and/or modified sequence opt5 from hemagglutinin__InfluenzaA__AFJ77858
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcacccaaagaucccagcagacagugauuccgaacaucgggucucggccccgcgucagagauauuccuagccggaucuccaucuacuggaccauugugaagcccggagacaugcugcugaucaauagcaccggcaaccucauugcuccucgcggguacuuuaaaaucagaucuggaaaguccagcauuaugcggucugacgcccccaucggcaaguguaauagcgagugcaucacaccgaacggcuccauuccuaaugauaaacccuuccagaacgugaaucgcaucacguauggggcuuguccuagauacgucaagcaaaacacccugaaacuugccacaggaaugcggaauguucccgaaaagcagacccgcggcauuuuuggggcgaucgccggauucauugagaacggcugggaagggaugguggacggaugguauggcuuuagacaccaaaauucugagggcacagggcaggcugccgaucugaaaagcacccaggcugccaucaaccagaucaauggaaagcucaacaaacugauuggcaagacgaacgagaaguuccaccagaucgaaaaagaguucuccgaaguggaggggcggauucaagaccuugaaaaguacgucgaggauacaaaaaucgaccuguggagcuauaaugccgagcuccugguggcucuggaaaaccagcauaccauugaucucaccgacucugagaugaauaagcuguuugaaagaaccaaaaagcagcuucgcgagaacgcggaagauaugggaaauggcugcuucaagaucuaccacaaaugugacaacgccugcauuggguccauccggaauggcacauaugaucaugacguuuacagagacgaggcucugaacaaucgcuuucagaucaagggaguggagcucaaaagcggcuacaaggauuggauucuguggaucucuuucgccauuuccugcuuucuuuucugugucgcccugcucggguuuaucaugugggcuugccaaaaaggaaacauucgguguaauaucugcaucuga

SEQ ID NO: 191879 - RNA, 1701 nt, Artificial Sequence
  derived and/or modified sequence opt5 from hemagglutinin__InfluenzaA__AFJ77869
augaagaccaucauugccuucagcuacauccugugccucguguuugcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuccaaaacaaaaagugggaucuguuugucgaaagaagcaaagccuauuccaauuguuacccuuaugacgugcccgauuacgcuucucugcggagccucguugccuccagcggaacgcuggaguucaacaaugaaucuuuuaacuggaccggcgugacacagaauggcaccuccagcgcuugcaagcgcagaucuaacaauuccuucuuuagccggcuuaacuggcugacacaucucaaguucaaauauccugcccugaaugucaccaugcccaacaacgagaaguuugacaaacuuuacaucuggggagugcaccauccugggacggauaaugaccagauuucucuguaugcgcaggccuccggccgcaucacaguuagcaccaagagaucccaacagacagugauuccgaacaucgggucucggccccgcgucagagauauuccuagccggaucuccaucuacuggaccauugugaaacccggagacauccuccugauuaauagcaccggcaaccugaucgcuccucgcggguacuucaagauuagaucuggaaaguccagcaucaugcggucugacgcccccaucggcaaauguaauagcgagugcauuacaccgaacggcuccaucccuaaugauaagcccuuucagaacgugaaucgcauuacguauggggcuuguccuagauacgucaaacagaacacccucaagcuggccacaggaaugcggaauguucccgaaaaacaaacccgcggcaucuucggggcgauugccggauuuaucgagaacggcugggaagggaugguggacggaugguauggcuucagacaccaaaauucugagggcacagggcaggcugccgaucuuaagagcacccaggcugccaucaaccagauuaauggaaaacugaaccggcucaucggcaagacgaacgagaaguuccaccagauugaaaaagaguuuuccgaaguggaggggagaauccaggaccuggaaaaguacgucgaggauacaaaaauugaccuuuggagcuauaaugccgagcugcucguggcucuggaaaaccaacauaccaucgaucugaccgacucugagaugaauaaacucuucgaacgcacaaagaagcagcugcgggagaacgcggaagauaugggaaauggcugcuuuaagauuuaccacaaaugugacaacgccugcaucggguccaucagaaauggcaccuaugaucaugacguuuaccgcgacgaggcucuuaacaaucgguuccagauuaagggaguggagcugaaaagcggcuacaaggauuggauccucuggauuucuuuugccaucuccugcuuccugcuuugugucgcccugcucggguuuauuaugugggcuugccagaaaggaaacaucagauguaauaucugcauuuga

SEQ ID NO: 191880 - RNA, 1701 nt, Artificial Sequence
  derived and/or modified sequence opt5 from hemagglutinin__InfluenzaA__AFJ77880
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaaguccuuuuucagccggcugaacuggcucacacaucugaaauuuaaguauccugcccuuaaugucaccaugcccaacaacgagaaauucgauaagcuguacaucuggggagugcaccauccugggacggacaaugaucagauuucucucuaugcgcaggccuccggccgcaucacaguuagcaccaaaagaucccaacagacagugauuccgaacaucgggucucggccccgcgucagagacgugccuagccggauuuccaucuacuggaccaucgugaagcccggagauauucugcugaucaauagcaccggcaaccucauugcuccucgcggguacuuuaagaucagaucuggaaaauccagcauuaugcggucugacgcccccaucggcaaguguaauagcgagugcaucacaccgaacggcuccauuccuaaugacaaacccuuccagaacgucaaucgcaucacguauggggcuuguccuagauacguuaagcagaacacccugaaacuugccacaggaaugcggaaugugcccgaaaagcaaacccgcggcauuuuuggggcgaucgccggauucauugagaacggcugggaagggaugguggauggaugguauggcuuuagacaccaaaauucugagggcacagggcaggcugccgaccugaaaagcacccaggcugccaucaaccagaucaauggaaagcucaaccggcugauuggcaagacgaacgagaaauuccaccagaucgaaaaggaguucuccgaagucgaggggcgcauucaggaucuugaaaaauacguggaggacacaaagaucgaucuguggagcuauaaugccgagcuccugguugcucuggaaaaccaacauaccauugaccucaccgauucugagaugaauaaacuguuugaaagaacaaagaagcagcuucgggagaacgcggaagacaugggaaauggcugcuucaaaaucuaccacaagugugauaacgccugcauuggguccaucagaaauggcaccuaugaccaugauguguaccgcgacgaggcucugaacaaucgguuucagaucaaaggagucgagcucaagagcggcuacaaagacuggauucuguggaucucuuucgccauuuccugcuuucuucuguguguggcccuccugggguucaucaugugggcuugccagaagggaaacauuagauguaauaucugcaucuga

SEQ ID NO: 191881 - RNA, 1701 nt, Artificial Sequence
  derived and/or modified sequence opt5 from hemagglutinin__InfluenzaA__AFJ77902
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuggccucuaugcgcaggccucugggcgcaucacaguuuccaccaagagaagccaacagacagugauuccgaacaucggaucccggccccgcgucagagauauuccuucucggaucagcaucuacuggaccauugugaaacccggcgacaugcugcugaucaauuccaccgggaaccucauugcuccucgcggauacuuuaagaucagaagcggcaagucuuccauuaugcggagcgacgcccccaucggcaaauguaauucugagugcaucacaccgaacgggagcauuccuaaugauaagcccuuccagaacgugaaucgcaucacguauggagcuuguccuagauacgucaaacagaacacccugaaacuugccacaggcaugcggaauguucccgaaaaacaaacccgcgggauuuuuggagcgaucgccggcuucauugagaacgggugggaaggaaugguggacggcugguauggcuuuagacaccaaaauuccgaggggacaggacaggcugccgaucugaagucuacccaggcugccaucaaccagaucaauggcaaacucaaccggcugauugggaagacgaacgagaaguuccaccagaucgaaaaagaguucagcgaaguggagggacgcauucaggaccuugaaaaguacgucgaggauacaaaaaucgaccugugguccuauaaugccgagcuccugguggcucuggaaaaccaacauaccauugaucucaccgacagcgagaugaauaagcuguuugaaagaacaaagaagcagcuucgggagaacgcggaagauaugggcaaugggugcuucaagaucuaccacaaaugugacaacgccugcauuggcucuaucagaaauggaaccuaugaucaugacguuuaccgcgacgaggcucugaacaaucgguuucagaucaagggcguggagcucaaauccggguacaaggauuggauucuguggaucagcuucgccauuucuugcuuucuucugugugucgcccuccugggauucaucaugugggcuugccagaaaggcaacauuagauguaauaucugcaucuga

SEQ ID NO: 191882 - RNA, 1701 nt, Artificial Sequence
  derived and/or modified sequence opt5 from hemagglutinin__InfluenzaA__AFJ77913
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcaggauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauaucccgcccuuaaugucaccaugccuaacaacgagaaguucgacaaacuguacaucuggggagugcaccaucccgggacggauaaugaccagauuucucucuaugcgcaagccuccggccgcaucacaguuagcaccaagagaucccagcagacagugauuccuaacaucgggucucggccgcgcgucagagauauucccagccggaucuccaucuacuggaccauugugaaaccuggagacaugcugcugaucaauagcaccggcaaccucauugcuccccgcggguacuuuaagaucagaucuggaaaguccagcauuaugcggucugacgccccuaucggcaaauguaauagcgagugcaucacacccaacggcuccauuccgaaugauaagccuuuccagaacgugaaucgcaucacguauggggcuugucccagauacgucaaacaaaacacccugaaacuugccacaggaaugcggaauguuccugaaaaacagacccgcggcauuuuuggggcgaucgccggauucauugagaacggcugggaagggaugguggacggaugguauggcuuuagacaccagaauagcgagggcacagggcaagcugccgaucugaagucuacccaggcugccaucaaccagaucaauggaaaacucaaccggcugauuggcaagacgaacgagaaguuccaccagaucgaaaaagaguucuccgaaguggaggggcgcauucaagaccuugaaaaguacgucgaggauacaaaaaucgaccuguggagcuauaaugccgagcuccugguggcucuggaaaaccagcauaccauugaucucaccgacucugagaugaauaagcuguuugaaagaacaaagaagcagcuucgggagaacgcggaagauaugggaaauggcugcuucaagaucuaccacaaaugugacaacgccugcauuggguccaucagaaauggcaccuaugaucaugacguuuaccgcgacgaggcucugaacaaucgguuucagaucaagggaguggagcucaaaagcggcuacaaggauuggauucuguggaucucuuucgccauuuccugcuuucuucugugugucgcccuccugggguucaucaugugggcuugccaaaaaggaaacauuagauguaauaucugcaucuga

SEQ ID NO: 191883 - RNA, 1701 nt, Artificial Sequence; identical to SEQ ID NO: 184137
  derived and/or modified sequence opt5 from hemagglutinin__InfluenzaA__AFJ77924

SEQ ID NO: 191884 - RNA, 1701 nt, Artificial Sequence
  derived and/or modified sequence opt5 from hemagglutinin__InfluenzaA__AFJ77935
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgggauuugcgacucuccgcaccagauccuugauggagagaauuguacccugauggacgcccuccugggcgauccccagugcgacggguuucaaaacaaaaagugggaucuguucguggaaagaagcaaagccuauuccaauuguuacccuuaugacguucccgaucaugcuucucuccggagccugguggccuccagcggaacgcuugaguuuaacaaugaaucuuucaacuggaccggcgucacacagaauggcaccuccagcgcuugcaagcgcagaucuaacaauuccuuuuucagccggcugaacuggcucacacaccugaaguuuaaauacccugcccuuaaugugaccaugcccaacaacgagacguucgacaagcuguauaucuggggaguucaucacccugggacagauaaugaccagauuucucucuacgcgcaggccuccggccgcaucaccgugagcacaaaaagaucccaacagaccgucauuccgaacaucgggucucggccccgcgugagagauauuccuagccggaucuccauuuauuggaccaucgugaagcccggagacauccugcugauuaauagcacaggcaaccucaucgcuccucgcggguacuuuaaaauuagaucuggaaaguccagcaucaugcggucugacgcccccauuggcaaguguaauagcgagugcaucacgccgaacggcuccaucccuaaugauaaacccuuccagaacgucaaucgcauuaccuacggggcuuguccuagauauguuaagcagaacacacugaaacuugccaccggaaugcggaaugugcccgaaaagcaaacacgcggcaucuuuggggcgauugccggauucaucgagaacggcugggaagggaugguggacggaugguacggcuuuagacaccaaaauucugagggcaccgggcaggcugccgaucugaaaagcacgcaggcugccauuaaccagaucaauggaaagcucaaccggcugaucggcaaaacaaacgagaaguuccaucagauugaaaaggaguucuccgaagucgaggggagaauccaggaccuugaaaaauauguggaggauaccaagauugaccuguggagcuacaaugccgagcuccugguugcucuggaaaaccaacacaccaucgaucucacagacucugagaugaauaaacuguuugaacgcaccaagaaacagcuucgggagaacgcggaagauaugggaaauggcugcuucaagauuuaucauaagugugacaacgccugcaucggguccauuagaaauggcacauacgaucacgacguguaucgcgacgaggcucugaacaaucgguuucagaucaaaggagucgagcucaagagcggcuacaaagauuggauccuguggauuucuuucgccaucuccugcuuucuucuguguguggcccuccugggguucauuaugugggcuugccagaagggaaacaucagauguaauauuugcaucuga

SEQ ID NO: 191885 - RNA, 1701 nt, Artificial Sequence
  derived and/or modified sequence opt5 from hemagglutinin__InfluenzaA__AFJ77946
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacaugcugcugaucaauagcaccggcaaccucauugcuccucgcggguacuuuaagaucagaucuggaaaguccagcauuaugcggucugacgcccccaucggcaaauguaauagcgagugcaucacaccgaacggcuccauuccuaaugauaagcccuuccagaacgugaaucgcaucacguauggggcuuguccuagauacauuaaacagaacacccugaaacuugccacaggaaugcggaauguccccgaaaaacaaacccgcggcaucuuuggggcgauugccggauucaucgagaacggcugggaagggaugguugacggaugguauggcuuuagacaccagaauagcgagggcacagggcaggcugccgaucugaagucuacccaagcugccaucaaccagauuaauggaaaacucaaccggcugaucggcaagacgaacgagaaguuccaccagauugaaaaagaguucuccgaaguggaggggagaauccaggaccuugaaaaguacguggaggauacaaaaauugaccuguggagcuauaaugccgagcuccuggucgcucuggaaaaccaacauaccaucgaucucaccgacucugagaugaauaagcuguuugaacgcacaaagaagcagcuucgggagaacgcggaagauaugggaaauggcugcuucaagauuuaccacaaaugugacaacgccugcaucggguccaucagaaauggcaccuaugaucaugacguguaccgcgacgaggcucugaacaaucgguuucagauuaagggaguugagcucaaaagcggcuacaaggauuggaucauuuggaucucuuucgccauuuccugcuuucugcuuuguguggcccugcucggguucaucaugugggcuugccagaaaggaaacaucagauguaauauuugcaucuga

SEQ ID NO: 191886 - RNA, 1701 nt, Artificial Sequence; identical to SEQ ID NO: 184777
  derived and/or modified sequence opt5 from hemagglutinin__InfluenzaA__AFJ77957

SEQ ID NO: 191887 - RNA, 1701 nt, Artificial Sequence; identical to SEQ ID NO: 183654
  derived and/or modified sequence opt5 from hemagglutinin__InfluenzaA__AFJ77968

SEQ ID NO: 191888 - RNA, 1701 nt, Artificial Sequence
  derived and/or modified sequence opt5 from hemagglutinin__InfluenzaA__AFJ77979
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucagauccggcuacaaagacuggauucuguggaucagcuuugccauuucuugcuuccuucugugugucgcccuccugggguuuaucaugugggcuugccagaagggaaauauccgcuguaacauuugcaucuga

SEQ ID NO: 191889 - RNA, 1701 nt, Artificial Sequence
  derived and/or modified sequence opt5 from hemagglutinin__InfluenzaA__AFJ77990
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugaugaguaccgcgacgaggcucugaauaaccgguuccagaucaagggaguugaacucaaauccggcuacaaggacuggauucuguggaucagcuuugccauuucuugcuuccuucugugugugacccuccugggguuuaucaugugggccugccagaaaggaaauaucagauguaacauuugcaucuga

SEQ ID NO: 191890 - RNA, 1701 nt, Artificial Sequence
  derived and/or modified sequence opt5 from hemagglutinin__InfluenzaA__AFJ78001
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggcaaaaauuguacccugauugacgcccuccugggagauccccagugcgacgauuuucaaaacaagaaaugggaccuguucgucgagagaagcaaggccuauuccaauuguuacccuuaugaugugcccgacuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaauuuaaguauccugcccuuaaugucaccaugcccaacaacgaaaaauucgauaagcuguacaucuggggcgugcaccauccugggacggacaaugaucagauuuuucucuaugcgcaggccucuggacgcaucacaguuuccaccaaaagaagccaacagacagugauuccgaacaucggcucccggccccgcgucagaaauauuccuucucggaucagcaucuacuggaccauugugaagcccggggacauccugcugauuaacuccaccggaaaucucaucgcuccucgcggcuacuucaagauuagaagcgggaaaucuuccaucaugcggagcgacgcccccaucggaaaguguaacucugagugcauuacaccgaauggcagcaucccuaacgauaaacccuuucagaaugugaaccgcauuacguauggcgcuuguccuagauacgucaagcagaauacccugaaacuugccacagggaugcggaacguucccgagaagcaaacccgcggaaucuucggcgcgauugccggguuuaucgaaaauggaugggagggcaugguggacgggugguauggauucagacaccagaacuccgaaggcaucggccaggcugccgaucugaaaucuacacaagcugccauuaaucagaucaacgggaagcucaaccggcugauuggaaagaccaaugagaaauuccaccagaucgagaaggaauuuagcgagguggaaggccgcauucaggaccuugagaaauacgucgaagauacgaagaucgaccugugguccuauaacgccgagcuccugguggcucuggagaaucaacauacaauugaucucaccgacagcgaaaugaacaaacuguucgagagaaccaagaagcagcuucgggaaaaugcggaggauauggggaacggaugcuuuaaaaucuaccacaagugugacaaugccugcaucggcucuauuagaaacgggacauaugaucaugacguuuaccgcgacgaagcucugaauaaccgguuccagaucaaaggcguggagcucaaguccggauacaaagauuggauucuguggaucagcuuugccauuucuugcuuccuucugugugucacccuccugggcuuuaucaugugggccugccagaaggggaauaucagauguaacauuugcaucuga

SEQ ID NO: 191891 - RNA, 1701 nt, Artificial Sequence
  derived and/or modified sequence opt5 from hemagglutinin__InfluenzaA__AFJ78012
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagcccauuccaauuguuauccuuacgacgugcccgauuaugcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaccugaaguuuaaauacccugcccuuaaugucaccaugcccaacaacgagaaguucgacaaacuguauaucuggggagugcaucacccugggacggauaaugaccagauuuuucucuacgcgcaggccucuggccgcaucacaguuuccaccaagagaagccaacagacagugauuccgaacaucgggucccggccccgcgucagaaauauuccuucucggaucagcaucuauuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguacggggcuuguccuagauaugucaaacagaauacccugaaacuugccacaggaaugcggaacguucccgaaaagcaaacccgcggcaucuucggggcgauugccggauuuaucgagaauggcugggaagggaugguggauggaugguacggcuucagacaccagaacuccgagggcaucgggcaggcugccgaccugaagucuacacaagcugccauugaucagaucaauggaaaacucaaccggcugauuggcaagaccaacgagaaguuccaucagaucgaaaaagaguuuagcgaaguggaggggcgcauucaggaccuugaaaaguaugucgaggauacgaaaaucgaccugugguccuacaaugccgagcuccugguggcucuggaaaaccaacacacaauugaucucaccgacagcgagaugaauaagcuguucgaaagaaccaaaaagcagcuucgggagaacgcggaagauaugggaaauggcugcuuuaagaucuaucauaaaugugacaacgccugcaucgggucuauuagaaauggcacauacgaucacgacguuuaucgcgacgaggcucugaacaaucgguuccagaucaagggaguggagcucaaauccggcuacaaggauuggauucuguggaucagcuuugccauuucuugcuuccuucugugugucgcccuccugggguuuaucaugugggcuugccagaaaggaaacaucagauguaauauuugcaucuga

SEQ ID NO: 191892 - RNA, 1701 nt, Artificial Sequence
  derived and/or modified sequence opt5 from hemagglutinin__InfluenzaA__AFJ78023
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaauuccuuuuucagcagacugaacuggcucacacaucugaaauuuaaguauccugcccuuaaugucaccaugcccaacaacgagaaauucgacaagcuguacaucuggggagugcaccauccugggacggauaaugaccagauuuuucucuaugcgcaggccucuggccggaucacaguuuccaccaaacgcagccaacagacagugauuccgaacaucggguccagaccccggguccgcaauauuccuucuagaaucagcaucuacuggaccauugugaagcccggagauauccugcugauuaacuccaccggcaaucucaucgcuccucggggguacuucaagauucgcagcggaaaaucuuccaucaugagaagcgacgcccccaucggcaaguguaacucugagugcauuacaccgaauggcagcaucccuaacgacaaacccuuucagaaugugaaccggauuacguauggggcuuguccucgcuacgucaagcagaauacccugaaacuugccacaggaaugagaaacguucccgaaaagcaaacccggggcaucuucggggcgauugccggauuuaucgagaauggcugggaagggaugguggauggaugguauggcuuccgccaccagaacuccgagggcaucgggcaggcugccgaccugaaaucuacacaagcugccauuaaucagaucaacggaaagcucaacagacugauuggcaagaccaaugagaaauuccaccagaucgaaaaggaguuuagcgaaguggaggggcggauucaggaucuugaaaaauacgucgaggacacgaagaucgaucugugguccuauaacgccgagcuccugguggcucuggaaaaucaacauacaauugaccucaccgauagcgagaugaacaaacuguucgaaagaaccaagaagcagcuucgcgagaaugcggaagacaugggaaacggcugcuuuaaaaucuaccacaagugugauaaugccugcaucgggucuauucggaacggcacauaugaccaugauguuuacagagacgaggcucugaauaaccgcuuccagaucaaaggaguggagcucaaguccggcuacaaagacuggauucuguggaucagcuuugccauuucuugcuuccuucugugugucgcccuccugggguuuaucaugugggcuugccagaagggaaauauccgguguaacauuugcaucuga

SEQ ID NO: 191893 - RNA, 1701 nt, Artificial Sequence; identical to SEQ ID NO: 183654
  derived and/or modified sequence opt5 from hemagglutinin__InfluenzaA__AFJ78034

SEQ ID NO: 191894 - RNA, 1701 nt, Artificial Sequence
  derived and/or modified sequence opt5 from hemagglutinin__InfluenzaA__AFJ78045
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagccgggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggagugcaccauccugggacggauaaugaccagauuuuucucuaugcgcaggccucuggcagaaucacaguuuccaccaaacggagccaacagacagugauuccgaacaucgggucccgccccagaguccggaauauuccuucucgcaucagcaucuacuggaccauugugaagcccggagauauccugcugauuaacuccaccggcaaucucaucgcuccuagaggguacuucaaaauucggagcggaaagucuuccaucaugcgcagcgacgcccccaucggcaaguguaacucugagugcauuacaccgaauggcagcaucccuaacgacaaacccuuucagaaugugaacagaauuacguauggggcuuguccucgguacgucaagcagaauacccugaaacuugccacaggaaugcgcaacguucccgaaaagcaaaccagaggcaucuucggggcgauugccggauuuaucgagaauggcugggaagggaugguggauggaugguauggcuuccggcaccagaacuccgagggcauggggcaggcugccgaccugaaaucuacacaagcugccaucaaucagauuaacggaaagcucaacagacugaucggcaaaaccaaugagaaguuccaccagauugaaaaggaguuuagcgaaguggaggggcgcauccaggaucuugaaaaauacgucgaggacacgaagauugaucugugguccuauaacgccgagcuccugguggcucuggaaaaucaacauacaaucgaccucaccgauagcgagaugaacaaacuguucgaacggaccaagaaacagcuuagagagaaugcggaagacaugggaaacggcugcuuuaagauuuaccacaagugugauaaugccugcaucgggucuauccgcaacggcacauaugaccaugauguuuaccgggacgaggcucugaauaacagauuccagauuaaaggaguggagcucaaguccggcuacaaagacuggauccuguggauuagcuuugccaucucuugcuuccuucugugugucgcccuccugggguuuauuaugugggcuugccagaagggaaauaucaaauguaacaucugcauuuga

SEQ ID NO: 191895 - RNA, 1701 nt, Artificial Sequence; identical to SEQ ID NO: 183654
  derived and/or modified sequence opt5 from hemagglutinin__InfluenzaA__AFJ78056

SEQ ID NO: 191896 - RNA, 1701 nt, Artificial Sequence
  derived and/or modified sequence opt5 from hemagglutinin__InfluenzaA__AFJ78067
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggacggucuuccaucaugcgcagcgacgcccccaucggcaaguguaacucugagugcauuacaccgaauggcagcaucccuaacgacaaacccuuucagaaugugaacagaauuacguauggggcuuguccucgguacgucaagcagaauacccugaaacuugccacaggaaugcgcaacguucccgaaaagcaaaccagaggcaucuucggggcgauugccggauuuaucgagaauggcugggaagggaugguggauggaugguauggcuuccggcaccagaacuccgagggcaucgggcaggcugccgaccugaaaucuacacaagcugccauuaaucagaucaacggaaagcucaacagacugauuggcaaaaccaaugagaaguuccaccagaucgaaaaggaguuuagcgaaguggaggggcgcauucaggaucuugaaaaauacgucgaggacacgaagaucgaucugugguccuauaacgccgagcuccugguggcucuggaaaaucaacauacaauugaccucaccgauagcgagaugaacaaacuguucgaacggaccaagaaacagcuuagagagaaugcggaagacaugggaaacggcugcuuuaagaucuaccacaagugugauaaugccugcaucgggucuauucgcaacggcacauaugaccaugauguuuaccgggacgaggcucugaauaacagauuccagaucaaaggaguggagcucaaguccggcuacaaagacuggauucuguggaucagcuuugccauuucuugcuuccuucugugugucgcccuccugggguuuaucaugugggcuugccagaagggaaauauccgcuguaacauuugcaucuga

SEQ ID NO: 191897 - RNA, 1701 nt, Artificial Sequence
  derived and/or modified sequence opt5 from hemagglutinin__InfluenzaA__AFJ78078
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucgacaaauguaacucugagugcauuacaccgaauggcagcaucccuaacgauaagcccuuucagaaugugaaccgcauuacguauggcgcuuguccuagauacgucaaacagaauacccugaaacuugccacagggaugcggaacguucccgaaaaacaaacccgcggaaucuucggcgcgauugccggguuuaucgagaauggaugggaaggcaugguggacgggugguauggauucagacaccagaacuccgagggcaucggccaggcugccgaucugaagucuacacaagcugccauugaccagaucaaugggaaacucaaccggcugauuggaaagaccaacgagaaguuccaccagaucgaaaaagaguuuagcgaaguggagggccgcauucaggaucuugaaaaguacgucgaggacacgaaaaucgaucugugguccuauaaugccgagcuccugguggcucuggaaaaccaacauacaauugaccucaccgauagcgagaugaauaagcuguucgaaaagaccaagaagcagcuuagagagaacgcggaagacauggggaauggaugcuuuaaaaucuaccacaagugugauaacgccugcaucggcucuauucggaaugggacauaugaccaugacguuuacagagaugaggcucugaacaaucgcuuccagaucaaaggcguggagcucaaguccggauacaaagacuggauucuguggaucagcuuugccauuucuugcuuccuucugugugucgcccuccugggcuuuaucaugugggcuugccagaaggggaacauccgguguaauauuugcaucuga

SEQ ID NO: 191898 - RNA, 1701 nt, Artificial Sequence; identical to SEQ ID NO: 191821
  derived and/or modified sequence opt5 from hemagglutinin__InfluenzaA__AFJ78089

SEQ ID NO: 191899 - RNA, 1701 nt, Artificial Sequence; identical to SEQ ID NO: 184852
  derived and/or modified sequence opt5 from hemagglutinin__InfluenzaA__AFJ78100

SEQ ID NO: 191900 - RNA, 1701 nt, Artificial Sequence
  derived and/or modified sequence opt5 from hemagglutinin__InfluenzaA__AFJ78111
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaauuucgacaagcuguacaucuggggagugcaccauccugggacggauaacgaccagauuuuucucuaugcgcaggccucuggccgcaucacaguuuccaccaaaagaagccaacagacagugauuccgaauaucgggucccggccccgcgucagaaacauuccuucucggaucagcaucuacuggaccauugugaagcccggagauauccugcugauuaauuccaccggcaaccucaucgcuccucgcggguacuucaaaauuagaagcggaaagucuuccaucaugcggagcgacgcccccaucggcaaguguaauucugagugcauuacaccgaacggcagcaucccuaaugacaaacccuuucagaacgugaaucgcauuacguauggggcuuguccuagauacgucaagcagaacacccugaaacuugccacaggaaugcggaauguucccgaaaagcaaacccgcggcaucuucggggcgauugccggauuuaucgagaacggcugggaagggaugguggauggaugguauggcuucagacaccaaaauuccgagggcaucgggcaggcugccgaccugaaaucuacacaggcugccauugaucagaucaacggaaagcucaaccggcugauuggcaaaaccaaugagaaguuccaccagaucgaaaaggaguuuagcgaaguggaggggcgcauucaggaccuugaaaaauacgucgaggauacgaagaucgaccugugguccuauaacgccgagcuccugguggcucuggaaaaucaacauacaauugaucucaccgacagcgagaugaacaaacuguucgaaaagaccaaaaagcagcuuagagagaaugcggaagauaugggaaacggcugcuuuaagaucuaccacaaaugugacaaugccugcaucgggucuauucggaacggcacauaugaucaugacguuuacagagacgaggcucugaauaaccgcuuccagaucaagggaguggagcucaaauccggcuacaaggauuggauucuguggaucagcuuugccauuucuugcuuccuucugugugucgcccuccugggguuuaucaugugggcuugccagaaaggaaauauccgguguaacauuugcaucuga

SEQ ID NO: 191901 - RNA, 1701 nt, Artificial Sequence
  derived and/or modified sequence opt5 from hemagglutinin__InfluenzaA__AFJ78122
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgggaucugcgacucuccgcaccagauucuugauggagagaauuguacccugaucgacgcccuccugggcgauccccagugcgacggguuucaaaacaaaaagugggaucuguucguggaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucuuucucuaugcgcaggccucuggccgcauuacaguguccaccaagagaagccaacagacaguuaucccgaacauugggucccggccccgcgugagaaauaucccuucucggaucagcauuuacuggaccaucgucaaacccggagauauucugcugaucaacuccaccggcaaucucauugcuccucgcggguacuucaagaucagaagcggacggucuuccaucaugcgcagcgacgcccccauugacaaguguaacucugagugcaucacaccgaauggcagcauuccuaacgauaaacccuuucagaaugugaacagaaucacguauggcgcuuguccucgguacgugaagcagaauacccugaaacuugccacagggaugcgcaacguccccgaaaagcaaaccagaggaauuuucggcgcgaucgccggguuuaucgagaauggaugggaaggcaugguugacgggugguauggauuccggcaccagaacuccgagggcauuggccaggcugccgaucugaaaucuacacaagcugccaucgaccagauuaaugggaagcucaacagacugauccgcaaaaccaacgagaaguuccaccagauugaaaaggaguuuagcgaaguggagggacggauccaggaucuugaaaaauacguggaggacacgaagauugaucugugguccuauaaugccgagcuccuggucgcucuggaaaaccaacauacaaucgaccucaccgauagcgagaugaauaaacuguucgaaaagaccaaaaagcagcuuagagagaacgcggaagacaugggcaaugggugcuuuaagaucuaccacaaaugugauaacgccugcauuggaucuauccgcaauggcacauaugaccaugacguguaccgggaugaggcucugaacaauagauuccagauuaaggggguugagcucaaauccggcuacaaggacuggauccuguggauuagcuuugccaucucuugcuuccuucuguguguggcccuccugggauuuaucaugugggcuugccagaaaggcaacauucgcuguaauaucugcauuuga

SEQ ID NO: 191902 - RNA, 1701 nt, Artificial Sequence
  derived and/or modified sequence opt5 from hemagglutinin__InfluenzaA__AFJ78144
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcauccgcagauccaacaauagcuuuuucucucggcugaacuggcucacacaucugaaguuuaaguauccugcucuuaaugucaccaugcccaacaacgagaaauucgacaagcuguacauuuggggcgugcaccauccugggacggauaaugaccagaucuuucucuaugcccaggcguccggacgcauuacaguuagcaccaaaagaucccaacagacagugaucccgaacauuggcucucggccccgcgucagaaauaucccuagccggaucuccauuuacuggaccaucgugaagcccggggauauucugcugaucaacagcaccggaaaucucauugccccucgcggcuacuucaaaaucagaucugggaaguccagcaucaugcggucugacgcucccauuggaaaguguaacagcgaaugcaucacaccgaauggcuccauuccuaacgacaaacccuuucagaaugugaaccgcaucacguauggcgccuguccuagauacgucaagcagaauacccugaaacuugcuacagggaugcggaacguucccgagaagcaaacccgcggaauuuucggcgccaucgcgggguuuaucgaaaauggaugggagggcaugguggaugggugguauggauucagacaccagaacucugagggcauuggccaggccgcugaccugaaaagcacacaagccgcuaucgaucagauuaaugggaagcucaaccggcugaucggaaaaaccaacgaaaaguuccaccagauugagaaggaauuuuccgagguggaaggcagaauccaggaccuugagaaauacgucgaggauacgaagguggaccuguggagcuauaaugccgaacuccugguugcccuggagaaccaacauacaauugaucucaccgacucugaaaugaauaaacuguucgagaagaccaaaaagcagcuucgcgaaaacgcugaggauauggggaauggaugcuuuaagaucuaccacaaaugugacaacgcgugcaucggcuccauucggaaugggacauaugaucaugacguguacagagacgaggcccugaacaaucgcuuccagaucaagggcgucgaacucaaaagcggauacaaggauuggauucuguggaucucuuuugcuauuuccugcuuccuucuguguguggcccuccugggcuuuaucaugugggccugccagaaagggaacauccgguguaauauuugcaucuga

SEQ ID NO: 191903 - RNA, 1701 nt, Artificial Sequence; identical to SEQ ID NO: 191902
  derived and/or modified sequence opt5 from hemagglutinin__InfluenzaA__AFJ78155

SEQ ID NO: 191904 - RNA, 1701 nt, Artificial Sequence
  derived and/or modified sequence opt5 from hemagglutinin__InfluenzaA__AFJ78166
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccugggacggauaaugaccagaucuuucucuaugcgcaggccucuggacgcauuacaguuuccaccaagagaagccaacagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacagaauacccugaaacuugccacagggaugcggaacguucccgaaaaacaaacccgcggaauuuucggcgcgaucgccggguuuaucgagaauggaugggagggcaugguggaugggugguauggauucagacaccagaacuccgaaggcauuggccaggcugccgaccugaagucuacacaagcugccaucgaucagauuaaugggaaacucaaccggcugaucggaaagaccaacgagaaauuccaccagauugaaaaggaguuuagcgaaguggagggcagaauccaggaccuugagaaguacgucgaagauacgaaaauugaccugugguccuauaaugccgagcuccugguggcucuggaaaaccaacauacaaucgaucucaccgacagcgagaugaauaagcuguucgaaaagaccaagcgccagcuucgggagaacgcggaggauauggggaauggaugcuuuaaaaucuaccacaagugugacaacgccugcauuggcucuaucagaaaugggacauaugaucaugacguuuaccgcgacgaagcucugaacaaucgguuccagauuaagggcguggagcucaaauccggauacaaggauuggauccuguggauuagcuuugccaucucuugcuuccuucugugugucgcccuccugggcuuuaucaugugggcuugccagaaagggaacauuagauguaauaucugcauuuga

SEQ ID NO: 191905 - RNA, 1701 nt, Artificial Sequence; identical to SEQ ID NO: 184753
  derived and/or modified sequence opt5 from hemagglutinin__InfluenzaA__AFJ78177

SEQ ID NO: 191906 - RNA, 1701 nt, Artificial Sequence
  derived and/or modified sequence opt5 from hemagglutinin__InfluenzaA__AFJ78188
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcaucagaaauaucccuucucggauuagcaucuacuggaccauugucaagcccggggauauccugcugauuaacuccaccggaaaucucaucgcuccucgcggcuacuucaaaaucagaagcgggaagucuuccauuaugcggagcgacgcccccaucggaaaguguaacucugaaugcauuacaccgaauggcagcaucccuaacgacaaacccuuucagaaugugaaccgcauuacguauggcgcuuguccuagauacgugaagcagaauacccugaaacuugccacagggaugcggaacguccccgagaagcaaacccgcggaaucuucggcgcgaucgccggguuuauugaaaauggaugggagggcaugguugaugggugguauggauucagacaccagaacuccgagggcacaggccaggcugccgaccugaaaucuacccaagcugccaucgaucagauuaaugggaagcucaaccggcugaucggaaaaacgaacgaaaaguuccaccagauugagaaggaauuuagcgagguggaaggcagaauccaggaccuugagaaauacguggaggauacaaagauugaccugugguccuauaaugccgaacuccuggucgcucuggagaaccaacauaccaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguguacagagacgaggcucugaacaaucgcuuccagauuaagggcguugaacucaaauccggauacaaggauuggauccuguggauuagcuuugccaucucuugcuuccuucuguguguggcccuccugggcuuuaucaugugggcuugccagaaagggaacauucgguguaauaucugcauuuga

SEQ ID NO: 191907 - RNA, 1701 nt, Artificial Sequence
  derived and/or modified sequence opt5 from hemagglutinin__InfluenzaA__AFJ78210
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcacaggccaggcugccgaccugaaaucuacccaagcugccauugaucagaucaaugggaagcucaaccggcugauuggaaaaacgaacgaaaaguuccaccagaucgagaaggaauuuagcgagguggaaggccgcauucaggaccuugagaaauacgucgaggauacaaagaucgaccugugguccuauaaugccgaacuccugguggcucuggagaaccaacauaccauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcauugaacucaaauccggauacaaggauuggauccuguggauuagcuuugccaucucuugcuuccuucuguguguggcccuccugggcuuuaucaugugggcuugccagaaagggaacauucgguguaauaucugcauuuga

SEQ ID NO: 191908 - RNA, 1701 nt, Artificial Sequence; identical to SEQ ID NO: 191832
  derived and/or modified sequence opt5 from hemagglutinin__InfluenzaA__AFJ78221

SEQ ID NO: 191909 - RNA, 1701 nt, Artificial Sequence
  derived and/or modified sequence opt5 from hemagglutinin__InfluenzaA__AFJ78232
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcaaaaucugcgacucuccgcaccagauccuugauggggagaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaacaauuccuuuuucagccggcugaacuggcucacacaucugaaguuuaaauauccugcccuuaaugucaccaugcccaacaacgaggaguucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcacaggccaggcugccgaccugaaaucuacccaagcugccauugaucagaucaaugggaagcucaaccggcugauuggaaaaacgaacgaaaaguuccaccagaucgagaaugaauuuagcgagguggaaggccgcauucaggaccuugagaaguacgucgaggauacaaaaaucgaccugugguccuauaacgccgaacuccugguggcucuggagaaucaacauaccauugaucucaccgacagcgaaaugaacaagcuguucgagaaaacaaagaaacagcuuagagaaaaugcggaggauauggggaacggaugcuuuaagaucuaccacaagugugacaaugccugcaucggcucuauucggaacgggaccuaugaucaugacguuuacagagacgaggcucugaauaaccgcuuccagaucaaaggcguggaacucaaguccggauacaaagauuggauucuguggaucagcuuugccauuucuugcuuccuucugugugucgcccuccugggcuuuaucaugugggcuugccagaaggggaauauccgguguaacauuugcaucuga

SEQ ID NO: 191910 - RNA, 1701 nt, Artificial Sequence
  derived and/or modified sequence opt5 from hemagglutinin__InfluenzaA__AFJ78243
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccugggacggauaaugaccagaucuuucucuaugcgaaggccucuggacgcauuacaguuuccaccaaaagaagccagcaaacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccgugggaaaguguaacucugaaugcauuacaccgaauggcagcaucccuaacgacaaacccuuucagaaugucaaccgcauuacguauggcgcuuguccuagauacguuaagcagaauacccugaaacuugccacagggaugcggaacgugcccgaaaagcagacccgcggaaucuucggcgcgauugccggguuuaucgagaauggaugggagggcaugguggaugggugguauggauucagacacaaaaacuccgaaggcacaggccaagcugccgaccugaagucuacccaggcugccaucgaucagauuaaugggaaacucaaccggcugaucggaaagacgaacgagaaguuccaccaaauugaaaaagaguuuagcgaagucgagggcagaauccaggaccuugagaaguacguggaagauacaaaaauugaccugugguccuauaaugccgagcuccugguugcucuggaaaaccagcauaccaucgaucucaccgacagcgagaugaauaagcuguucgagaaaacaaagaagcagcuucgcgaaaacgcggaggauauggggaauggaugcuuuaaaauuuaccacaagugugacaacgccugcaucggcucuauccggaaugggaccuaugaucaugacguguacagagacgaagcucugaacaaucgcuuccaaauuaaaggcgucgagcucaaguccggauacaaagauuggauccuguggauuagcuuugccaucucuugcuuccuucuguguguggcccuccugggcuuuauuaugugggcuugccagaaggggaacauccgguguaauaucugcauuuga

SEQ ID NO: 191911 - RNA, 1701 nt, Artificial Sequence
  derived and/or modified sequence opt5 from hemagglutinin__InfluenzaA__AFJ78254
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccugggacggauaaugaccagaucuuucucuaugcgcaggccucuggacgcauuacaguuuccaccaagagaagccaacagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacagaauacccugaaacuugccacagggaugcggaacguucccgaaaaacaaacccgcggaauuuucggcgcgaucgccggguuuaucgagaauggaugggagggcaugguggaugggugguauggauucagacaccagaacuccgaaggcauuggccaggcugccgaccugaagucuacacaagcugccaucgaucagauuaaugggaaacucaaccggcugaucggaaagaccaacgagaaauuccaccagauugaaaaggaguuuagcgaaguggagggcagaauccaggaccuugagaaguacgucgaagauacgaaaguggaccugugguccuauaaugccgagcuccugguugcucuggaaaaccaacauacaauugaucucaccgacagcgagaugaauaagcuguucgaaaagaccaagaaacagcuucgcgagaacgcggaggauauggggaauggaugcuuuaagaucuaccacaagugugacaacgccugcaucggcucuauucggaaugggacauaugaucaugacguguacagagacgaagcucugaacaaucgcuuccagaucaaaggcgucgagcucaaguccggauacaaagauuggauucuguggaucagcuuugccauuucuugcuuccuucuguguguggcccuccugggcuuuaucaugugggcuugccagaaggggaacauccgguguaauauuugcaucuga

SEQ ID NO: 191912 - RNA, 1701 nt, Artificial Sequence; identical to SEQ ID NO: 191911
  derived and/or modified sequence opt5 from hemagglutinin__InfluenzaA__AFJ78265

SEQ ID NO: 191913 - RNA, 1701 nt, Artificial Sequence
  derived and/or modified sequence opt5 from hemagglutinin__InfluenzaA__AFJ78276
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagguggaccugugguccuauaaugccgaacuccugguugcucuggagaaccaacauacaauugaucucaccgacagcgaaaugaauaaacuguucgagaagaccaaaaagcagcuucgcgaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcgucgaacucaaauccggauacaaggauuggauucuguggaucagcuuugccauuucuugcuuccuucuguguguggcccuccugggcuuuaucaugugggcuugccagaaagggaacauccgguguaauauuugcaucuga

SEQ ID NO: 191914 - RNA, 1701 nt, Artificial Sequence
  derived and/or modified sequence opt5 from hemagglutinin__InfluenzaA__AFJ78287
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauggacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauucgcagaucuaagaacuccuuuuucagccggcugaauuggcucacacaucugaacuuuaaauauccugcccuuaaugucaccaugcccaacaacgagcaguucgacaagcuguacaucuggggcgugcaccauccugggacggauaaagaccagauuuuuccguaugcgcaagccucuggacgcaucacaguuuccaccaagagaagccagcagacagugauucccaauaucggcucccggccucgcgucagaaacauucccucucggaucagcaucuacuggaccauugugaaaccuggggauauccuccugauuaauuccaccggaaaccugaucgcuccccgcggcuacuucaagauuagaagcgggaagucuuccaucaugcggagcgacgccccgaucggaaaauguaauucugagugcauuacaccuaacggcagcauccccaaugacaagccuuuucagaacgugaaucgcauuacguauggcgcuugucccagauacgucaaacaaaacacccucaagcuggccacagggaugcggaauguucccgaaaaacagacccgcggaaucuucggcgcgauugccggguuuaucgagaacggaugggaaggcaugguggaugggugguauggauucagacaccaaaauuccgagggccggggccaggcugccgaccuuaagucuacacaggcugccaucgaucagauuaacgggaaacugaauagacucaucggaaagaccaacgagaaguuccaccagauugaaaaagaguuuagcgaaguggagggccgcauccaagaccuggaaaaguacgucgaggauacgaaaauugaccuuugguccuauaacgccgagcugcucguggcucuggaaaaucagcauacaaucgaucugaccgacagcgagaugaacaaacucuucgaaaagaccaagaagcagcugcgggagaaugcggaagauauggggaacggaugcuuuaaaauuuaccacaagugugacaaugccugcaucggcucuaucagaaacgggacauaugaucaugacguuuaccgcgacgaggcucuuaauaaccgguuccagauuaaaggcguggagcugaaguccggauacaaagauuggauccucuggauuagcuuugccaucucuugcuuccugcuuugugucgcccugcucggcuuuauuaugugggcuugccaaaaggggaauaucagauguaacaucugcauuuga

SEQ ID NO: 191915 - RNA, 1698 nt, Artificial Sequence
  derived and/or modified sequence opt5 from hemagglutinin__InfluenzaA__AFJ78309
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggaucagagagccauuuaccacacagagaacgcuuaugugucugucguuagcucccauuacagccggcgcuucaccccggaaaucgccaaaagacccaaggugcgggaccaggagggccgcauuaauuauuacuggacgcuccuggagccuggggauacaaucauuuuugaagcgaacggaaaucuuaucgcccccugguaugcuuucgcccugucuagaggcuuuggguccggaauuaucaccagcaacgcuccuauggacgagugugaugccaagugccagacaccccaaggcgcgaucaauucuagccucccguuccagaacgugcacccuauuaccaucggcgaaugucccaaauacguccgguccgccaagcugcgcauggugaccgggcuuagaaauauuccuucuauccagagccggggacuguuuggcgcuauugccggguucaucgagggaggcuggacagggaugaucgacggaugguauggcuaccaucaccagaacgaacaaggcuccggguacgcugccgaucagaaaagcacgcagaaugccauuaacggaaucaccaauaagguuaacucugugauugagaaaaugaauacacaguuuaccgcugucggcaaggaguucaacaaacucgaacgcagaauggagaaucugaacaagaagguggacgauggguuccuggacaucuggacauauaacgcggaacuccugguucuucuggagaaugaacggacccucgacuuucacgauuccaacgugaaaaaucuguacgagaaggucaaaagccaacuuaagaacaaugccaaagagauuggaaacggcugcuucgaauuuuaucauaaguguaauaacgagugcauggaaucugugaagaaugggacguacgacuaucccaaauacuccgaggagagcaagcugaaccgcgagaaaaucgauggcgucaagcucgaauccaugggaguguaucagauccuggcuauuuacucuacaguugccagcucccuggugcuccuggucucucuuggcgccaucagcuucuggaugugcuccaaugggagccugcaguguagaauuugcaucuga

SEQ ID NO: 191916 - RNA, 1701 nt, Artificial Sequence
  derived and/or modified sequence opt5 from hemagglutinin__InfluenzaA__AFJ78320
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucggaaagacaaaugaaaaguuucaucagaucgagaaagaguucuccgaaguggaaggccgcauucaggaucuggagaaguauguugaggacaccaaaaucgaucucuggagcuacaacgcugaacugcugguggcgcucgagaaccaacacacgauugaccugacagauucugaaaugaauaaacuuuucgagcgcaccaagaagcagcugcgggaaaacgccgaggacauggggaauggaugcuuuaagaucuaucauaaaugugauaacgcuugcauuggcuccaucagaaaugggaccuacgaccacgaugucuaccgcgacgaggcccucaacaaucgguuccagauuaagggcguggaacugaaaagcggauauaaggacuggauccuuuggaucuccuuugccauuucuugcuuccugcucuguguugugcugcugggcuuuaucaugugggcuugccagaaagggaacauuagauguaauaucugcauuuga

SEQ ID NO: 191917 - RNA, 1698 nt, Artificial Sequence
  derived and/or modified sequence opt5 from hemagglutinin__InfluenzaA__AFJ78331
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuaaguccuacguuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuugguaugcuuucgcccuguccagaggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcggucugccaagcugcgcaugguuaccggacucagaaauauucccagcauccagucccggggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacuccgugaucgaaaagaugaauacacaguuuaccgcuguugggaaagaguucaacaaacuggagcgcagaauggaaaaucucaacaagaagguggacgauggauuccuggacauuuggacauauaacgcggagcuucugguccuccuggaaaaugagcggacccuugacuuucacgauagcaacgugaaaaaucuguacgaaaaggucaaaucucaacucaagaacaaugccaaagagaucggcaacgggugcuucgaguuuuaucauaaguguaauaacgaaugcauggaguccgugaagaauggcacguacgacuaucccaaauacagcgaagagucuaagcugaaccgcgagaaaauugauggaguuaagcuggaauccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 191918 - RNA, 1698 nt, Artificial Sequence; identical to SEQ ID NO: 191917
  derived and/or modified sequence opt5 from hemagglutinin__InfluenzaA__AFJ78342

SEQ ID NO: 191919 - RNA, 1698 nt, Artificial Sequence; identical to SEQ ID NO: 191917
  derived and/or modified sequence opt5 from hemagglutinin__InfluenzaA__AFJ78353

SEQ ID NO: 191920 - RNA, 1698 nt, Artificial Sequence
  derived and/or modified sequence opt5 from hemagglutinin__InfluenzaA__AFJ78364
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggaucagagagccauuuaccacacagagaacgcuuaugugucugucguuagcucccauuacaaucggcgcuucaccccggaaaucgccaaaagacccaaggugcggaaccaggagggccgcauuaauuauuacuggacgcuccuggagccuggggacacaaucauuuuugaagcgaacggaaaucuuaucgcccccugguaugcuuucgcccugagcagaggcuuugggucuggaauuaucaccuccaacgcuccuauggaugagugugacgccaagugccagacaccccaaggcgcgaucaauagcucucucccguuccagaacgugcacccuauuaccaucggcgaaugucccaaauacguccggagcgccaagcugcgcauggugaccgggcuuagaaauauuccuuccauccagucucggggacuguuuggcgcuauugccggguucaucgagggaggcuggacagggaugaucgauggaugguauggcuaccaucaccagaacgaacaaggcagcggguacgcugccgaccagaaauccacgcagaaugccauuaacggaaucaccaauaagguuaacagcgugauugagaaaaugaauacacaguuuaccgcugucggcaaggaguucaacaaacucgaacgcagaauggagaaccugaauaagaagguggaugacggguuccuggauaucuggacauauaacgcggaacuccugguucuucuggagaaugaacggacccucgacuuucacgacucuaacgugaaaaaucuguacgagaaggucaaaucccaacuuaagaacaaugccaaagagauuggaaacggcugcuucgaauuuuaucauaaguguaauaacgagugcauggaaagcgugaagaaugggacguacgauuaucccaaauacucugaggaguccaagcugaaccgcgagaaaaucgacggcgucaagcucgaaagcaugggaguguaucagauccuggcuauuuacuccacaguugccucuagccuggugcuccuggucucccuuggcgccaucucuuucuggaugugcagcaaugggucccugcaguguagaauuugcaucuga

SEQ ID NO: 191921 - RNA, 1698 nt, Artificial Sequence
  derived and/or modified sequence opt5 from hemagglutinin__InfluenzaA__AFJ78375
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccaucaaucuccuggaaaacucucacaaugggaaacuuugccugcucaagggaauugcuccccugcagcugggcaacuguagcgucgccggguggauccucggaaauccugagugcgaacugcuuauuuccaaagagucuuggagcuacaucguggaaaccccgaaccccgagaauggcacguguuauccugggcauuuugccgauuacgaggaacugagagagcaacucuccucuguuagcuccuucgaacgguuugagaucuuccccaaggagagcucuuggccuaaccacaccgugacaggagucuccgcuagcugcucucauaauggcaaguccagcuuuuaucgcaaccugcuuuggcugaccgaaaagaauggccucuaccccaaccugucuaaguccuaugugaauaacaaagagaaggaaguucuggugcucuggggaguccaccacccuagcaacauuggggaccagagagccaucuaccauacagagaaugcuuacguguccguggucucuagccacuauucccggcgcuucaccccggaaauuguuaaaagacccaaggugcgggaucaggagggccgcaucaacuacuauuggacgcugcuugagccuggggacacaauuaucuuugaagccaauggaaaccugauugcgcccugguacgccuucgcucucagcagaggcuuugggucuggaaucaucaccuccaaugccccuauggaugagugugacgcuaagugccagacaccccaaggcgccauuaacagcucucugccguuccagaaugugcauccugucaccaucggcgaaugucccaaauaugugcggagcgcgaaacuucgcaugguuaccgggcugagaaacauuccuuccauccagucucggggacucuuuggcgccauugcuggguucaucgagggaggcuggacagggaugaucgauggaugguacggcuaucaccaccagaaugaacaaggcagcggguacgccgcugaccagaaauccacgcagaacgccauuaauggaaucaccaacaaggugaauagcauuaucgagaaaaugaacacacaguuuaccgccgucggcaaggaguucaauaaacuggaacgcagaauggagaaccugaacaagaagguggaugacggguuccucgauauuuggacauacaaugcugaacugcuuguucugcucgagaacgaacggacccuggacuuucaugacucuaaugugaaaaaccuuuaugagaaggucaaaucccaacugaagaauaacgcgaaagagaucggaaauggcugcuucgaauuuuaccacaaguguaacaaugagugcauggaaagcgugaagaacgggacguaugauuaccccaaauauucugaggaguccaagcucaaucgcgagaaaaucgacggcgucaagcuggaaagcaugggaguguaccagauucuggccaucuauuccacaguugcuucuagccucgugcugcuugucucccugggcgccauuucuuucuggaugugcagcaacgggucccuccaguguagaaucugcauuuga

SEQ ID NO: 191922 - RNA, 1698 nt, Artificial Sequence; identical to SEQ ID NO: 184409
  derived and/or modified sequence opt5 from hemagglutinin__InfluenzaA__AFJ78386

SEQ ID NO: 191923 - RNA, 1698 nt, Artificial Sequence; identical to SEQ ID NO: 184409
  derived and/or modified sequence opt5 from hemagglutinin__InfluenzaA__AFJ78397

SEQ ID NO: 191924 - RNA, 1698 nt, Artificial Sequence; identical to SEQ ID NO: 191101
  derived and/or modified sequence opt5 from hemagglutinin__InfluenzaA__AFJ78408

SEQ ID NO: 191925 - RNA, 1698 nt, Artificial Sequence
  derived and/or modified sequence opt5 from hemagglutinin__InfluenzaA__AFJ78419
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccuggguacuuugccgacuaugaggaacugagagagcaacucuccucugucagcuccuucgaacgguuugagaucuuccccaaggagagcucuuggccuaaucauacggugaccggaguuuccgccagcugcucucacaacggcaaauccagcuuuuacaagaaucugcuuuggcugacaggcaaaaacgggcucuaucccaaucugucuaaguccuacgcuaacaauaaagaaaaggaggugcugguccucuggggagugcaucacccuccgaacaucggcgaucagcgcgcccuguaccacaccgaaaacgcuuaugugagcgucguuuccucucauuacagcagaaaguucacacccgagauugccaaacggccuaaggugcgcgaccaggaagggagaaucaauuauuacuggacccuucuggagcccggagauacggugauuuuugaggcgaacggcaaucucaucgccccucgguaugcuuucgcccugucccgcggguuuggaagcggcauuaucaacucuaaugcucccauggacgaaugugaugccaaaugccagacaccgcaaggcgcgauuaacuccagccuuccuuuccagaauguccaccccgugaccaucggggaguguccuaaguacguuagaucugccaaacugcggauggugacaggacuccgcaacauccccagcauucaguccagaggccuguuuggggcuaucgccggauucauugaaggcggguggaccggaauggucgacggcugguauggcuaccaucaccagaaugagcaagggucuggauacgcugccgaucagaaguccacccagaacgccaucaauggcauuacaaacaaagugaauagcguuaucgaaaagaugaacacgcaguuuaccgcuguggggaaggaguucaauaaacuggagcggcgcauggaaaaccucaacaagaaagucgacgauggauucaucgacauuuggacauauaaugcggagcugcuugugcugcucgaaaacgagagaacccuggacuuucacgauagcaaugucaagaaccuuuacgaaaaagugaagucucaacugaagaauaacgccaaagagaucggcaaugggugcuucgaguuuuaucauaaguguaacgacgaaugcauggaguccguuaaaaauggcacauacgauuaucccaaguacagcgaagagucuaaacucaaccgggagaagauugacggagugaagcuggaauccaugggcgucuaucagauccuggcuauuuacagcaccguggccuccucucucguucugcuugugagccugggggccaucuccuucuggaugugcucuaauggaagccuccagugucgcaucugcauuuga

SEQ ID NO: 191926 - RNA, 1698 nt, Artificial Sequence
  derived and/or modified sequence opt5 from hemagglutinin__InfluenzaA__AFJ78430
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaauccgaaccccgagaauggcaccuguuauccugggcauuuugccgacuacgaggaacugcgggagcaacucuccucugucagcuccuucgaacgcuuugagaucuuccccaaagagagcucuuggccuaaccacacggugaccggaguuuccgccagcugcucucauaauggcaaguccagcuuuuauaagaaccugcuuuggcugacaggcaaaaaugggcucuaccccaaccugucuaaguccuaugcuaauaacaaagaaaaggaggugcugguccucuggggagugcaccacccuccgaacaucggcgaucagagagcccuguaccauaccgaaaaugcuuacgugagcgucguuuccucucacuauagccggaaauucacacccgagauugccaagcgcccuaaggugagagaccaggaagggcggaucaacuacuauuggacccuucugggacccggcgauacgauuaucuuugaggcgaaugggaaccucauugccccucgcuacgcuuucgcccuguccagaggauuuggcagcggcaucauuaauucuaacgcucccauggacgagugugaugccaaaugccagacaccgcaaggggcgaucaauuccagccuuccuuuccagaacgugcaucccgucaccaucggagaauguccuaaguaugugcggucugccaaacugcgcaugguuacaggccucagaaauauucccagcauccagucccgggggcuguuuggagcuauugccggcuucaucgaagggggauggaccggcaugguggacggcugguacggguaucaccaccagaacgaacaaggaucuggcuacgcugccgaucaaaagagcacccagaaugccauuaacgggaucacaaauaaagucaacuccgugaucgagaagaugaauacgcaguuuaccgcuguuggaaaagaguucaacaagcuggagcgcagaauggagaaccucaauaagaaaguggacgauggcuucauugacaucuggacauacaacgcggaacugcuuguccugcucgagaaugaacggacccuggacuuucaugauagcaacgugaagaaucuuuaugagaaagucaagucucagcugaaaaacaaugccaaggaaauugggaacggcugcuucgaguuuuaccacaaguguaaugacgagugcauggaauccgugaaaaacggaacauaugauuaccccaaguauagcgaggaaucuaaacucaaucgcgagaagaucgacggcguuaaacuggaguccauggggguguaccagauucuggcuaucuauagcaccgucgccuccucucucgugcugcuuguuagccugggagccaucuccuucuggaugugcucuaacggcagccuccaguguagaauuugcaucuga

SEQ ID NO: 191927 - RNA, 1698 nt, Artificial Sequence
  derived and/or modified sequence opt5 from hemagglutinin__InfluenzaA__AFJ78441
augaaggugaaacugaugguccuccugugcaccuucacagccacguacgcugacaccaucuguauuggcuaucacgccaacaauagcacagauaccguugacacagugcuugagaagaacgugaccgucacacauuccgugaaucugcucgaagauucucacaacgggaaacugugccuucugaagggaaucgcgccccuccagcugggcaauuguagcguugcuggguggauucugggaaacccugagugcgaacuccugaucuccagagagucuuggagcuacauuguggaaaaaccgaaucccgagaacggcaccuguuauccugggcauuuugccgacuacgaggaacuucgggagcaacuguccucugucagcuccuucgaacgcuuugagaucuuccccaaggagagcucuuggccuaaucacacggugaccggaguuuccgccagcugcucucauaacggcaaguccagcuuuuauaaaaaucuccuguggcuuacaggcaagaacgggcuguaccccaaucucucuaaauccuaugcuaacaauaaggaaaaagaggugcugguccuguggggagugcaccacccuccgaacaucggcgaucagaaggcccucuaccauaccgaaaacgcuuacgugagcgucguuuccucucacuauagcagaaaguucacacccgagauugccaaacggccuaaggugcgcgaccaggaagggagaaucaauuacuauuggacccugcuugagcccggagauacgauuaucuuugaggcgaacggcaaucugauugccccucgguacgcuuucgcccucucccgcggguuuggaagcggcaucauuaacucuaaugcucccauggacgaaugugaugccaaaugccagacaccgcaaggcgcgaucaacuccagccugccuuuccagaaugugcaucccgucaccaucggggaguguccuaaguaugugagaucugccaaacuucggaugguuacaggacugcgcaacauucccagcauccaguccagaggccucuuuggggcuauugccggauucaucgaaggcggguggaccggaaugguggacggcugguacggcuaucaccaccagaaugagcaagggucuggauacgcugccgaucaaaagagcacccagaacgccauuaauggcaucacaaacaaagucaauuccgugaucgaaaagaugaacacgcaguuuaccgcuguugacaaggaguucaauaaacuggagcggcgcauggaaaaccugaacaagaaaguggaugacggguucauugacaucuggacauacaaugcggagcuccugguccuucuggaaaacgagagaacccucgauuuucaugacagcaaugugaagaaccuguaugaaaaagucaagucucagcuuaagaauaacgccaaagagauuggaaauggcugcuucgaguuuuaccacaaguguaacgaugaaugcauggaguccgugaaaaaugggacauaugacuaccccaaguauagcgaagagucuaaacugaaccgggagaagaucgauggcguuaagcucgaauccaugggaguguaccagauucuggcuaucuauagcaccgucgccuccucucuggugcuccugguuagccuuggcgccaucuccuucuggaugugcucuaaugggagccugcagugucgcauuugcaucuga

SEQ ID NO: 191928 - RNA, 1698 nt, Artificial Sequence
  derived and/or modified sequence opt5 from hemagglutinin__InfluenzaA__AFJ78452
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagaaggcccuguaccauaccgaaaacgcuuacgugagcgucguuuccucucacuauagccgcaaauucauucccgagaucgccaagagaccuaaagugcgggaccaggaagggcgcauuaauuacuauuggacacuucuggagcccggagauaccaucauuuuugaggcgaacggcaaucucaucgccccuagauacgcuuucgcccugucccggggguuuggaagcggcauuaucaacucuaaugcucccauggacgaaugugaugccaagugccagacgccgcaaggcgcgaucaacuccagccuuccuuuccagaaugugcaucccgucacaauuggggaguguccuaaauaugugcgcucugccaagcugagaaugguuaccggacuccggaacauccccagcauucagucccgcggccuguuuggggcuaucgccggauucauugaaggcggguggacaggaaugguggacggcugguacggcuaucaccaccagaaugagcaagggucuggauacgcugccgaucagaaaagcacccagaacgccaucaauggcaucaccaacaaggucaauuccgugauugaaaagaugaacacacaguuuacggcuguugggaaagaguucaauaagcuggagagacggauggaaaaccucaacaaaaagguggacgauggauucaucgacauuuggaccuacaaugcggagcugcuuguccugcucgaaaacgagcgcacacuggacuuucaugauagcaaugugaaaaaccuuuaugaaaaggucaagucucaacugaaaaauaacgccaaggagaucggcaaugggugcuucgaguuuuaccacaaauguaacgacgaaugcauggaguccgugaagaauggcaccuaugauuaccccaaauauagcgaagagucuaagcucaacagagagaagauugacggaguuaaacuggaauccaugggcguguaccagauccuggcuaucuauagcacagucgccuccucucucgugcugcuuguuagccugggggccauuuccuucuggaugugcucuaauggaagccuccagugucggaucugcauuuga

SEQ ID NO: 191929 - RNA, 1698 nt, Artificial Sequence
  derived and/or modified sequence opt5 from hemagglutinin__InfluenzaA__AFJ78463
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugggaaagucuuaugcuaacaauaaagaaaaggaggugcugguccucuggggcgugcaccacccuccgaacaucggggaucagaaggcccuguaccauaccgaaaacgcuuacguguccgucguuagcucccacuauucucgcaaauucauucccgagaucgccaagagaccuaaagugcgggaccaggaaggacgcauuaauuacuauuggacacuucuggagcccggcgauaccaucauuuuugaggcgaacgggaaucucaucgccccuagauacgcuuucgcccugagccggggauuuggcuccggcauuaucaacagcaaugcucccauggacgaaugugaugccaagugccagacgccgcaaggggcgaucaacucuucccuuccuuuccagaaugugcaucccgucacaauuggagaguguccuaaauaugugcgcagcgccaagcugagaaugguuaccggccuccggaacauccccucuauucagagccgcgggcuguuuggagcuaucgccggcuucauugaagggggauggacaggcaugguggacggcugguacggguaucaccaccagaaugagcaaggauccggcuacgcugccgaucagaaaucuacccagaacgccaucaaugggaucaccaacaaggucaauagcgugauugaaaagaugaacacacaguuuacggcuguuggaaaagaguucaauaagcuggagagacggauggaaaaccucaacaaaaagguggacgauggcuucaucgacauuuggaccuacaaugcggagcugcuuguccugcucgaaaacgagcgcacacuggacuuucaugauuccaaugugaaaaaccuuuaugaaaaggucaagagccaacugaaaaauaacgccaaggagaucgggaauggcugcuucgaguuuuaccacaaauguaacgacgaaugcauggagucugugaagaauggaaccuaugauuaccccaaauauuccgaagagagcaagcucaacagagagaagauugacggcguuaaacuggaaucuauggggguguaccagauccuggcuaucuauuccacagucgccagcucccucgugcugcuuguuucucugggagccauuagcuucuggaugugcuccaauggcucucuccagugucggaucugcauuuga

SEQ ID NO: 191930 - RNA, 1698 nt, Artificial Sequence
  derived and/or modified sequence opt5 from hemagglutinin__InfluenzaA__AFJ78474
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacggugaccggaguuuccgccagcugcucuuauaacggcaaguccagcuuuuacaaaaaucugcuuuggcugacaggcaagaacgggcucuaucccaaucugucuaaauccuacgcuaacaauaaggaaaaagaggugcugguccucuggggagugcaucacccuccgaacaucggcgaucagagagcccuguaccacaccgaaaacgcuuaugugagcgucguuuccucucauuacagccggaaguucacacccgagauugccaagcgcccuaaagugagagaccaggaagggcggaucaauuauuacuggacccuucuggagcccggagauacgauuaucuuugaggcgaacggcaaucucauugccccucgcuaugcuuucgcccuguccagaggguuuggaagcggcaucauuaacucuaaugcucccauggacgaaugugaugccaagugccagacaccgcaaggcgcgaucaacuccagccuuccuuuccagaaugugcaccccgucaccaucggggaguguccuaaauacgugcggucugccaagcugcgcaugguuacaggacucagaaacauucccagcauccagucccggggccuguuuggggcuauugccggauucaucgaaggcggguggaccggaaugguggacggcugguauggcuaccaucaccagaaugagcaagggucuggauacgcugccgaucagaaaagcacccagaacgccauuaauggcaucacaaacaaggucaauuccgugaucgaaaagaugaacacgcaguuuaccgcuguugggaaagaguucaauaagcuggagcgcagaauggaaaaccucaacaaaaagguggacgauggauucauugacaucuggacauauaaugcggagcugcuuguccugcucgaaaacgagcggacccuggacuuucacgauagcaaugugaaaaaccuuuacgaaaaggucaaaucucaacugaagaauaacgccaaggagauuggcaaugggugcuucgaguuuuaucauaaauguaacgacgaaugcauggaguccgugaagaauggcacauacgauuaucccaaauacagcgaagagucuaagcucaaccgcgagaaaaucgacggaguuaagcuggaauccaugggcguguaucagauucuggcuaucuacagcaccgucgccuccucucucgugcugcuuguuagccugggggccaucuccuucuggaugugcucuaauggaagccuccaguguagaauuugcaucuga

SEQ ID NO: 191931 - RNA, 1698 nt, Artificial Sequence
  derived and/or modified sequence opt5 from hemagglutinin__InfluenzaA__AFJ78485
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgaucagagagcccuguaccauacagagaacgcuuacgugagcguggucuccucucacuauagccggaaauucacccccgaaauugccaagcgcccuaagguuagagaccaggaggggcggaucaauuacuauuggacgcuucuggagcccggagauacaauuaucuuugaagcgaacggcaaucucauugccccucgcuacgcuuucgcccuguccagaggguuuggaagcggcaucauuaacucuaaugcucccauggacgagugugaugccaaaugccagaccccgcaaggcgcgaucaacuccagccuuccuuuccagaaugugcaucccgugacaaucggggaauguccuaaguauguccggucugccaaacugcgcauggugaccggacucagaaacauucccagcauccagucccggggccuguuuggggcuauugccggauucaucgagggcggguggaccggaaugguugacggcugguacggcuaucaccaccagaaugaacaagggucuggauacgcugccgaucagaaguccacacagaacgccauuaauggcaucacgaacaaagugaauagcgucaucgagaagaugaacacccaguuuacagcuguggggaaagaguucaauaagcuggaacgcagaauggagaaccucaacaagaaaguugaagacggauucauugauaucuggaccuacaaugcggagcugcuugugcugcucgaaaacgagcggacacuggacuuucaugacagcaaugucaagaaccuuuaugagaaagugaagucucaacugaaaaauaacgccaaggaaauuggcaaugggugcuucgaguuuuaccacaaguguaacgaugaaugcauggaguccgucaaaaauggcaccuaugacuaccccaaguauagcgaggaaucuaaacucaaccgcgagaagaucgauggagugaaacuggaauccaugggcguuuaccagauucuggcuaucuauagcacgguggccuccucucucguccugcuugugagccugggggccaucuccuucuggaugugcucuaauggaagccuccaguguagaauuugcaucuga

SEQ ID NO: 191932 - RNA, 1698 nt, Artificial Sequence
  derived and/or modified sequence opt5 from hemagglutinin__InfluenzaA__AFJ78496
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgggcagagagcccuguaccauacagagaacgcuuacgugagcguggucuccucucacuauagccggaaauucacccccgaaauugccaagcgcccuaagguuagagaucaggagggacggaucaauuacuauuggacgcuucuggagcccggcgacacaauuaucuuugaagcgaacgggaaucucauugccccucgcuacgcuuucgcccuguccagaggauuuggcagcggcaucauuaacucuaaugcucccauggaugagugugacgccaaaugccagaccccgcaaggggcgaucaacuccagccuuccuuuccagaaugugcaucccgugacaaucggagaauguccuaaguauguccggucugccaaacugcgcauggugaccggccucagaaacauucccagcauccagucccgggggcuguuuggagcuauugccggcuucaucgaagggggauggaccggcaugguugauggcugguacggguaucaccaccagaaugagcaaggaucuggcuacgcugccgaccagaaguccacacagaacgccauuaaugggaucacgaacaaagugaauagcgucaucgagaagaugaacacccaguuuacagcugugggaaaagaguucaauaagcuggaacgcagaauggagaaccucaacaagaaaguugaugacggcuucauugauaucuggaccuacaaugcggaacugcuugugcugcucgagaacgaacggacacuggacuuucaugacagcaaugucaagaaccuuuaugagaaagugaagucucaacugaaaaauaacgccaaggagauugggaauggcugcuucgaauuuuaccacaaguguaacgaugagugcauggaauccgucaaaaauggaaccuaugacuaccccaaguauagcgaggagucuaaacucaaccgcgaaaagaucgauggcgugaaacuggaguccauggggguuuaccagauucuggcuaucuauagcacgguggccuccucucucguccugcuugugagccugggagccaucuccuucuggaugugcucuaauggcagccuccaguguagaauuugcaucuga

SEQ ID NO: 191933 - RNA, 1698 nt, Artificial Sequence
  derived and/or modified sequence opt5 from hemagglutinin__InfluenzaA__AFJ78518
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgaucagagagcccuguaccauacagagaacgcuuacgugagcguggucuccucucacuauagccggaaauucacccccgaaauugccaagcgcccuaagguuagagaccaggaggggcggaucaauuacuauuggacgcuucuggagcccggagauacaauuaucuuugaagcgaacggcaaucucauugccccucgcuacgcuuucgcccuguccagaggguuuggaagcggcaucauuaacucuaaugcucccauggacgagugugaugccaaaugccagaccccgcaaggcgcgaucaacuccagccuuccuuuccagaaugugcaucccgugacaaucggggaauguccuaaguauguccggucugccaaacugcgcauggugaccggacucagaaacauucccagcauccagucccggggccuguuuggggcuauugccggauucaucgagggcggguggaccggaaugguugacggcugguacggcuaucaccaccagaaugaacaagggucuggauacgcugccgaucagaaguccacacagaacgccauuaauggcaucacgaacaaagugaauagcgucaucgagaagaugaacacccaguuuacagcuguggggaaagaguucaauaagcuggaacgcagaauggagaaccucaacaagaaaguugacgauggauucauugacaucuggaccuacaaugcggaacugcuugugcugcucgagaacgaacggacacuggacuuucaugauagcaaugucaagaaccuuuaugagaaagugaagucucaacugaaaaauaacgccaaggagauuggcaaugggugcuucgaauuuuaccacaaguguaacgacgagugcauggaauccgucaaaaauggcaccuaugauuaccccaaguauagcgaggagucuaaacucaaccgcgaaaagaucgacggagugaaacuggaguccaugggcguuuaccagauucuggcuaucuauagcacgguggccuccucucucguccugcuugugagccugggggccaucuccuucuggaugugcucuaauggaagccuccaguguagaauuugcaucuga

SEQ ID NO: 191934 - RNA, 1698 nt, Artificial Sequence
  derived and/or modified sequence opt5 from hemagglutinin__InfluenzaA__AFJ78529
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauaagaaccugcuuuggcugacaggcaaaaaugggcucuaccccaaccugagcaagucuuaugcuaauaacaaagagaaggaagugcugguccucuggggagugcaccacccuccgaacaucggcgaucagaugacccuguaccauaaagagaaugccuacguguccgucguuagcucccacuauucuagaaaguucacacccgaaauugcuaagcggccuaaagugcgcgaccaggaggggagaaucaacuacuauuggacccuucuggagcccggagauacgauuaucuuugaagccaauggcaaccucauugcgccucgguacgccuucgcucugagccgcggguuuggauccggcaucauuaauagcaacgcccccauggacgagugugaugcuaagugccagacaccgcaaggcgccaucaauucuucccuuccuuuccagaacgugcaucccgucaccaucggggaauguccuaaauaugugagaagcgcgaagcugcggaugguuacaggacuccgcaauauucccucuauccagagcagaggccuguuuggggccauugcuggauucaucgagggcggguggaccggaaugguggacggcugguacggcuaucaccaccagaacgaacaaggguccggauacgccgcugaucagaaaucuacccagaaugccauuaacggcaucacaaauaaggucaacagcgugaucgagaaaaugaauacgcaguuuaccgccguugggaaggaguucaacaagcuggaacggcgcauggagaaccucaauaaaaagguggacgauggauucauugacgucuggacauacaacgcugaacugcuugugcugcucgagaaugaaagaacccuggacuuucaugauuccaacgucaaaaaucuuuaugagaaggugaaaaaccaacugaagaauaacgcgaaggagaucggcaaugggugcuucgaauuuuaccacaaauguaacgacgagugcauggaaagcguuaagaauggcacauaugauuaccccaaauauucugaggaguccaagcucagccgggagaaaauugacggagugaagcuggaaucuaugggcgucuaccagauccuggccauuuauuccaccguggcuagcucccucguucugcuugugucucugggggccaucagcuucuggaugugcuccaacggaucucuccagugucgcaucugcauuuga

SEQ ID NO: 191935 - RNA, 1698 nt, Artificial Sequence; identical to SEQ ID NO: 191934
  derived and/or modified sequence opt5 from hemagglutinin__InfluenzaA__AFJ78540

SEQ ID NO: 191936 - RNA, 1698 nt, Artificial Sequence; identical to SEQ ID NO: 191934
  derived and/or modified sequence opt5 from hemagglutinin__InfluenzaA__AFJ78551

SEQ ID NO: 191937 - RNA, 1698 nt, Artificial Sequence
  derived and/or modified sequence opt5 from hemagglutinin__InfluenzaA__AFJ78562
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauaagaaccugcuuuggcugacaggcaaaaaugggcucuaccccacccugagcaagucuuaugcuaacaauaaagagaaggaagugcugguccucuggggagugcaccacccuccgaacaucggcgaucagaugacacuguaccauaaagagaacgccuacguguccgucguuagcucccacuauucuagaaaguucacccccgaaauugcuaagcggcuuaaagugcgcgaccaggaggggagaaucaauuacuauuggacgcugcucgagccuggagauacaauuaucuuugaagccaacggcaaucugauugcgccccgguacgccuucgcucuuagccgcgggcugggauccggcaucauuaacagcaaugccccuauggacgagugugaugcuaagugccagacaccccaaggcgccaucaacucuucccucccguuucagaaugugcauccugucaccaucggggaaugucccaaauaugugagaagcgcgaagcugcggaugguuaccggacugcgcaacauuccuucuauccagagcagaggccucuucggggccauugcuggauuuaucgagggcggguggaccggaaugguggacggcugguacggcuaucaccaccagaaugaacaaggguccggauacgccgcugaucagaaaucuacacagaacgccauuaauggcaucacgaacaaggucaauagcgugaucgagaaaaugaacacccaguucacagccguugggaaggaguuuaauaagcuggaacggcgcauggagaaccuuaacaaaaagguggacgauggauucauugacgucuggaccuacaaugcugaacugcucgugcugcuugagaacgaaagaacacuggacuuccaugauuccaaugucaaaaaccucuaugagaaggugaaaaaucaacugaagaacaaugcgaaggagaucggcaacgggugcuuugaguucuaccacaaauguaaugacgaaugcauggaaagcguuaagaacggcaccuaugauuaccccaaauauucugaggaguccaagcugagccgggagaaaauugacggagugaagcucgaaucuaugggcgucuaccagauccuggccauuuauuccacgguggcuagcucccuuguucugcucgugucucugggggccaucagcuuuuggaugugcuccaauggaucucugcagugucgcaucugcauuuga

SEQ ID NO: 191938 - RNA, 1698 nt, Artificial Sequence
  derived and/or modified sequence opt5 from hemagglutinin__InfluenzaA__AFJ78573
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauaagaaccugcuuuggcugacaggcaaaaaugggcucuaccccaaccugagcaagucuuaugcuaauaacaaagagaaggaagugcugguccucuggggagugcaccacccuccgaacaucggcgaucagaugacccuguaccauaaagagaaugccuacguguccgucguuagcucccacuauucuagaaaguucacacccgaaauugcuaagcggccuaaagugcgcgaccaggaggggagaaucaacuacuauuggacccuucuggagcccggagauacgauuaucuuugaagccaauggcaaccucauugcgccucgguacgccuucgcucugagccgcggguuuggauccggcaucauuaauagcaacgccucuauggacgagugugaugcuaagugccagacaccccaaggcgccaucaauuccagccuuccguuccagaacgugcauccugucaccaucggggaaugucccaaauaugugagaucugcgaagcugcggaugguuacaggacuccgcaauauuccuagcauccaguccagaggccuguuuggggccauugcuggauucaucgagggcggguggaccggaaugguggacggcugguacggcuaucaccaccagaacgaacaagggucuggauacgccgcugaucagaaaagcacccagaaugccauuaacggcaucacaaauaaggucaacuccgugaucgagaaaaugaauacgcaguuuaccgccguugggaaggaguucaacaagcuggaacggcgcauggagaaccucaauaaaaagguggacgauggauucauugacgucuggacauacaacgcugaacugcuugugcugcucgagaaugaaagaacccuggacuuucaugauagcaacgucaaaaaucuuuaugagaaggugaaaaaccaacugaagaauaacgcgaaggagaucggcaaugggugcuucgaauuuuaccacaaauguaacgacgagugcauggaaucuguuaagaauggcacauaugauuaccccaaauauuccgaggaggccaagcucagccgggagaaaauugacggagugaagcuggaaucuaugggcgucuaccagauccuggcuauuuauuccaccguggccagcucccucguucugcuugugucucugggggccaucagcuucuggaugugcuccaacggaucucuccagugucgcaucugcauuuga

SEQ ID NO: 191939 - RNA, 1698 nt, Artificial Sequence
  derived and/or modified sequence opt5 from hemagglutinin__InfluenzaA__AFJ78584
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaaaacuccuuuuaucgcaaucugcuuuggcugacacggaaaaacggccucuaccccaaucugagcaagucuuaugcuaacaacaaagagaaggaagugcugguccucuggggagugcaccacccuccgaauaucggggaccagaaagcccuguaccauaccgagaacgcuuacguguccgucguuagcucccacuauucuagaaaguucacacccgaaauugccaagcgcccuaaagugagagaucaggagggccggaucaauuacuauuggacccuucuggagcccggggacacgauuaucuuugaagcgaacggaaaucucauugccccucgcuacgcuuucgcccugagcagaggcuuuggguccggaaucauuaacagcaaugcucccauggauaagugugacgccaaaugccagacaccgcaaggcgcgaucaacucuucccuuccuuuccagaaugugcaucccgucgccaucggcgaguguccuaaguaugugcggagcgcuaaacugcgcaugguuaccgggcucagaaacauucccucuauccagagccggggacuguuuggcgccauugcuggguucaucgaaggaggcuggacagggaugguggauggaugguacggcuaucaccaccagaaugagcaaggcuccggguacgccgccgaccagaagucuacccagaacgcuauuaauggaaucaccaacaaagucaauagcgugaucgaaaagaugaacacacaguuuacggcgguuggcaaggaguucaacaaacuggagcgcagaauggaaaaucucaacaagaaaguggaugacggguucauugauaucuggaccuacaaugccgagcugcuuguccugcucgaaaacgagcggacacuggacuuucaugacuccaaugugaagaaccuuuaugaaaaagucaagagccaacugaagaauaacgcuaaagagauuggaaauggcugcuucgaguuuuaccacaaguguaacgaugaaugcauggagucugugaaaaaugggaccuaugacuaccccaaguauuccgaagagagcaaacucaaccgcgagaagaucgauggcguuaagcuggaaucuaugggaguguaccagauucuggccaucuauuccacagucgccagcucccucgugcugcuuguuucucugggcgcuaucagcuucuggaugugcuccaaugggucucuccaguguagaauuugcaucuga

SEQ ID NO: 191940 - RNA, 1698 nt, Artificial Sequence
  derived and/or modified sequence opt5 from hemagglutinin__InfluenzaA__AFJ78595
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacagagagaaagaagugcugguccucuggggagugcaccacccuccgaacaucggcgaccagaaggcccuguaccauaccgagaaugcuuacgugagcgucguuuccucucacuauagccggaaauucacacccgaaauugccaagcgcccuaaggugagagaucaggaggggcggaucaacuacuauuggacccuucuggagcccggagacacgauuaucuuugaagcgaauggcaaccucauugccccucgcuacgcuuucgcccuguccagaggguuuggaagcggcaucauuaauucuaacgcucccauggauaaaugugacgccaagugccagacaccgcaaggcgcgaucaauuccagccuuccuuuccagaacgugcaucccgucaccaucggggaguguccuaaauaugugcggucugccaagcugcgcaugguuacaggacucagaaauauucccagcauccagucccggggccuguuuggggcuauugccggauucaucgaaggcggguggaccggaaugguggauggcugguacggcuaucaccaccagaacgagcaagggucuggauacgcugccgaccagaaaagcacccagaaugccauuaacggcaucacaaauaaggucaacuccgugaucgaaaagaugaauacgcaguuuaccgcuguugggaaagaguucaacaagcuggagcgcagaauggaaaaccucaauaaaaagguggaugacggauucauugauaucuggacauacaacgcggagcugcuuguccugcucgaaaaugagcggacccuggacuuucaugacagcaacgugaaaaaucuuuaugaaaaggucaaaucucaacugaagaacaaugccaaggagauuggcaacgggugcuucgaguuuuaccacaaauguaaugaugaaugcauggaguccgugaagaacggcacauaugacuaccccaaauauagcgaagagucuaagcucaaucgcgagaaaaucgauggaguuaagcuggaauccaugggcguguaccagauucuggcuaucuauagcaccgucgccuccucucucgugcugcuuguuagccugggggccaucuccuucuggaugugcucuaacggaagccuccaguguagaauuugcaucuga

SEQ ID NO: 191941 - RNA, 1698 nt, Artificial Sequence
  derived and/or modified sequence opt5 from hemagglutinin__InfluenzaA__AFJ78617
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucaugacggcgaauccagcuuuuaucgcaaucugcuuuggcugacaggcaaaaacgggcucuaccccaaucugucuaaguccuaugcuaacaauaaagagaaggaagugcugguccucuggggagugcaccacccuccgagcaucuccgaucagaaaacccuguaccauacagagaacgcccacgugucugucguuagcucccauuacagcagaaaguucacccccgaaauugcuaagcggccuaaagugcgcgaccaggagggcagaaucaacuauuacuggacgcuucuggagcccggggauacaauuaucuuugaagccaauggaaaccucauugcgccucgguaugccuucgcucugucucgcggcuuuggguccggaaucauuaauagcaacgcccccauggacaagugugaugcuaaaugccagaccccgcaaggcgccaucaauucuagccuuccuuuccagaacgugcaccccgucacaaucggcgaguguccuaaguacgugagauccgcgaaacugcggaugguuaccgggcuccgcaauauucccucuauccagagcagaggacuguuuggcgccauugcuggguucaucgaaggaggcuggaccgggaugguggacggaugguauggcuaccaccaucagaacgagcaaggcuccggguaugccgcugaucaaaagagcacacagaaugccauuaacggaaucacgaauaaagucaacucugugaucgaaaagaugaauacccaguuuacagccguuuccaaggaguucaacaaacuggagcggcgcauggaaaaucucaacaagaaaguggacgauggcuucauugacaucuggaccuacaacgcugagcugcuuguccugcucgaaaaugagagaacacuggacuuucacgauagcaacgugaagaaucuuuacgaaaaagucaagucucagcugaagaacaaugcgaaagagauugggaacggaugcuucgaguuuuaucauaaguguaaugacgaaugcauggaguccgugaaaaacggcaccuacgauuaucccaaguacagcgaagaguccaaacucaaucgggagaagaucgacgggguuaagcuggaaucuaugggcguguaucagauucuggccaucuacagcacggucgcuuccucucucgugcugcuuguuagccugggagccaucuccuucuggaugugcagcaacggcucucuccagugucgcauuugcaucuga

SEQ ID NO: 191942 - RNA, 1698 nt, Artificial Sequence
  derived and/or modified sequence opt5 from hemagglutinin__InfluenzaA__AFJ78628
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaagaccgaaccccgagaauggcaccuguuauccugggcauuuugccgacuacgaggaacugcgggagcaacucagcuccgucucuagcuucgaacgcuuugagaucuuccccaaggaguccagcuggccuaaccacacggugaccggaguuucugccuccugcagccauaauggcgaaucuuccuuuuauaagaaccugcuuuggcugacaggcaaaaaugggcucuaccccaaccugagcaagucuuaugcuaauaacaaagagaaggaagugcugguccucuggggagugcaccacccuccgaacaucggcaaucagaugacccuguaccauaaagagaacgccuacguguccgucguuagcucccacuauucuagaaaguucacacccgaaauugcuaagcggccuaaagugcgcgaucaggaggggagaaucaauuacuauuggacccuucuggagcccggagacacgauuaucuuugaagccaacggcaaucucauugcgccucgguacgccuucgcucugagccgcggguuuggauccggcaucauuaacagcaaugcccccauggaugagugugacgcuaagugccagacaccgcaaggcgccaucaacucuucccuuccuuuccagaaugugcaucccgucaccaucggggaauguccuaaauaugugagaagcgcgaagcugcggaugguuacaggacuccgcaacauucccucuauccagagcagaggccuguuuggggccauugcuggauucaucgagggcggguggaccggaaugguggauggcugguacggcuaucaccaccagaaugaacaaggguccggauacgccgcugaccagaaaucuacccagaacgccauuaauggcaucacaaacaaggucaauagcgugaucgagaaaaugaacacgcaguuuaccgccguugggaaggaguucaacaagcuggaacggcgcauggagaaucucaacaaaaagguggaugacggauucauugaugucuggacauacaaugcugaacugcuugugcugcucgagaacgaaagaacccuggacuuucaugacuccaaugucaaaaaccuuuaugagaaggugaaaaaucaacugaagaacaaugcgaaggagaucggcaacgggugcuucgaauuuuaccacaaauguaaugaugagugcauggaaagcguuaagaacggcacauaugacuaccccaaauauucugaggaguccaagcucagccgggagaaaauugauggagugaagcuggaaucuaugggcgucuaccagauccuggccauuuauuccaccguggcuagcucccucguucugcuugugucucugggggccaucagcuucuggaugugcuccaauggaucucuccagugucgcaucugcauuuga

SEQ ID NO: 191943 - RNA, 1698 nt, Artificial Sequence
  derived and/or modified sequence opt5 from hemagglutinin__InfluenzaA__AFJ78639
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgagcaucuccaaccagaaaacccuguaccauacagagaaugccuacgugucugucguuagcucccacuauagcagaaaguucacccccgaaauugcuaagcggccuaaagugcgcgaccaggagggcagaaucaacuacuauuggacgcuucuggagcccggggauacaauuaucuuugaagccaauggaaaccucauugcgccucgguacgccuucgcucugucucgcggcuuuggguccggaaucauuaauagcaacgcccccauggacaagugugaugcuaaaugccagaccccgcaaggcgccaucaauucuagccuuccuuuccagaacgugcaucccgucacaaucggcgaguguccuaaguaugugagauccgcgaaacugcggaugguuaccgggcuccgcaauauucccucuauccagagcagaggacuguuuggcgccauugcuggguucaucgaaggaggcuggaccgggaugguggacggaugguacggcuaucaccaccagaacgagcaaggcuccggguacgccgcugaucaaaagagcacacagaaugccauuaacggaaucacgaauaaagucaacucugugaucgaaaagaugaauacccaguuuacagccguuggcaaggaguucaacaaacuggagcggcgcauggaaaaccucaauaagaaaguggacgauggguucauugacaucuggaccuacaacgcugagcugcuuguccugcucgaaaaugagagaacacuggauuuucaugacuccaacgugaagaaucuuuaugaaaaagucaagagccagcugaagaacaaugcgaaagagauuggaaacggcugcuucgaguuuuaccacaaguguaaugacgaaugcauggagucugugaaaaacgggaccuaugauuaccccaaguauuccgaagagagcaaacucaaucgggagaagaucgacggcguuaagcuggaauccaugggaguguaccagauucuggccaucuauucuacggucgcuagcucccucgugcugcuuguuucucugggcgccaucagcuucuggaugugcuccaacgggagccuccagugucgcauuugcaucuga

SEQ ID NO: 191944 - RNA, 1698 nt, Artificial Sequence; identical to SEQ ID NO: 191943
  derived and/or modified sequence opt5 from hemagglutinin__InfluenzaA__AFJ78650

SEQ ID NO: 191945 - RNA, 1701 nt, Artificial Sequence; identical to SEQ ID NO: 185693
  derived and/or modified sequence opt5 from hemagglutinin__InfluenzaA__AFJ78661

SEQ ID NO: 191946 - RNA, 1701 nt, Artificial Sequence
  derived and/or modified sequence opt5 from hemagglutinin__InfluenzaA__AFJ78681
augaaggccauccuggugguccuccuguacaccuucgcuacaguuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacgagauuaccaauaaggugaacuccguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccguuaaaaacggcaccuacgauuauccuaaguacagcgaggaagccaaacugaauagagaggagaucgacggggugaaacuugaaucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 191947 - RNA, 1701 nt, Artificial Sequence; identical to SEQ ID NO: 185693
  derived and/or modified sequence opt5 from hemagglutinin__InfluenzaA__AFJ78691

SEQ ID NO: 191948 - RNA, 1701 nt, Artificial Sequence; identical to SEQ ID NO: 185693
  derived and/or modified sequence opt5 from hemagglutinin__InfluenzaA__AFJ78701

SEQ ID NO: 191949 - RNA, 1701 nt, Artificial Sequence; identical to SEQ ID NO: 190221
  derived and/or modified sequence opt5 from hemagglutinin__InfluenzaA__AFJ78711

SEQ ID NO: 191950 - RNA, 1701 nt, Artificial Sequence; identical to SEQ ID NO: 185693
  derived and/or modified sequence opt5 from hemagglutinin__InfluenzaA__AFJ78721

SEQ ID NO: 191951 - RNA, 1701 nt, Artificial Sequence
  derived and/or modified sequence opt5 from hemagglutinin__InfluenzaA__AFJ78731
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcagcaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 191952 - RNA, 1701 nt, Artificial Sequence; identical to SEQ ID NO: 186857
  derived and/or modified sequence opt5 from hemagglutinin__InfluenzaA__AFJ78741

SEQ ID NO: 191953 - RNA, 1701 nt, Artificial Sequence; identical to SEQ ID NO: 185693
  derived and/or modified sequence opt5 from hemagglutinin__InfluenzaA__AFJ78751

SEQ ID NO: 191954 - RNA, 1701 nt, Artificial Sequence; identical to SEQ ID NO: 185693
  derived and/or modified sequence opt5 from hemagglutinin__InfluenzaA__AFJ78761

SEQ ID NO: 191955 - RNA, 1701 nt, Artificial Sequence; identical to SEQ ID NO: 185693
  derived and/or modified sequence opt5 from hemagglutinin__InfluenzaA__AFJ78771

SEQ ID NO: 191956 - RNA, 1701 nt, Artificial Sequence; identical to SEQ ID NO: 185693
  derived and/or modified sequence opt5 from hemagglutinin__InfluenzaA__AFJ78781

SEQ ID NO: 191957 - RNA, 1701 nt, Artificial Sequence; identical to SEQ ID NO: 185693
  derived and/or modified sequence opt5 from hemagglutinin__InfluenzaA__AFJ78791

SEQ ID NO: 191958 - RNA, 1701 nt, Artificial Sequence; identical to SEQ ID NO: 185693
  derived and/or modified sequence opt5 from hemagglutinin__InfluenzaA__AFJ78801

SEQ ID NO: 191959 - RNA, 1701 nt, Artificial Sequence; identical to SEQ ID NO: 186554
  derived and/or modified sequence opt5 from hemagglutinin__InfluenzaA__AFJ78811

SEQ ID NO: 191960 - RNA, 1701 nt, Artificial Sequence; identical to SEQ ID NO: 185693
  derived and/or modified sequence opt5 from hemagglutinin__InfluenzaA__AFJ78821

SEQ ID NO: 191961 - RNA, 1701 nt, Artificial Sequence; identical to SEQ ID NO: 185693
  derived and/or modified sequence opt5 from hemagglutinin__InfluenzaA__AFJ78831

SEQ ID NO: 191962 - RNA, 1701 nt, Artificial Sequence; identical to SEQ ID NO: 186891
  derived and/or modified sequence opt5 from hemagglutinin__InfluenzaA__AFJ78841

SEQ ID NO: 191963 - RNA, 1701 nt, Artificial Sequence; identical to SEQ ID NO: 185693
  derived and/or modified sequence opt5 from hemagglutinin__InfluenzaA__AFJ78851

SEQ ID NO: 191964 - RNA, 1701 nt, Artificial Sequence
  derived and/or modified sequence opt5 from hemagglutinin__InfluenzaA__AFJ78861
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguagacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 191965 - RNA, 1701 nt, Artificial Sequence
  derived and/or modified sequence opt5 from hemagglutinin__InfluenzaA__AFJ78881
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacauccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagccgccuguccccaugcuggcgccaaaucuuuuuauaagaaucugaucuggcucguuaaaaagggcaacuccuacccuaaacugagcaaguccuauauuaaugacaaggggaaagaagugcuuguccuguggggaauccaccaccccucuaccagcgcggaucaacagucccucuaccagaacgccgacgcuuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucaacgggguuaaacuugaauccacacggaucuaucaaauucuggcuaucuacagcacggccgcguccucucucgugcuggucgugagccugggcgcuauuuccuuuuggaugugcucuaauggaagccuccagugccgcaucuguauuuga

SEQ ID NO: 191966 - RNA, 1701 nt, Artificial Sequence; identical to SEQ ID NO: 185693
  derived and/or modified sequence opt5 from hemagglutinin__InfluenzaA__AFJ78891

SEQ ID NO: 191967 - RNA, 1701 nt, Artificial Sequence; identical to SEQ ID NO: 185693
  derived and/or modified sequence opt5 from hemagglutinin__InfluenzaA__AFJ78901

SEQ ID NO: 191968 - RNA, 1701 nt, Artificial Sequence; identical to SEQ ID NO: 185693
  derived and/or modified sequence opt5 from hemagglutinin__InfluenzaA__AFJ78911

SEQ ID NO: 191969 - RNA, 1701 nt, Artificial Sequence; identical to SEQ ID NO: 185693
  derived and/or modified sequence opt5 from hemagglutinin__InfluenzaA__AFJ78921

SEQ ID NO: 191970 - RNA, 1701 nt, Artificial Sequence
  derived and/or modified sequence opt5 from hemagglutinin__InfluenzaA__AFJ97567
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugaacaaguccuauauuaaugauaaggggaaagaagugcuuguccuguggggaauccaccaccccagcaccuccacagaccaacagucucucuaccagaacgccgaugcuuacguguucgugggcaccagcagauauuccaagaaauuuaagccugagauugccauccggccgaaaguccgcgaccaggaggggagaaugaauuacuauuggacgcugguugaacccggagauaagauuacauucgaggcuaccggcaaccugguggugccucgguacgccuuuacaauggaacgcaacgcggggagcggaaucauuaucucugacacccccguccaugacugcaauaccacaugucaaacgccuaaaggcgccaucaacaccuccuuccccuuucagaauauucacccgaucacaauuggcaagugcccuaaguaugugaaaagcaccaagcucagacuggcuacagggcuucggaacguucccucuauccagagccgcggacuguucggcgccauugcuggguuuaucgagggaggcuggaccgggaugguggauggaugguacggcuaucaucaccagaaugaacaaggcuccggguacgccgccgaccucaaaucuacgcagaacgcuaucgaugagauuacaaauaaggucaacagcgugaucgagaaaaugaauacccaguucaccgcgguuggaaaggaguucaaccaccuggagaagagaauugaaaaucuuaacaaaaagguggacgauggcuuucuggacaucuggacauacaaugccgagcuccugguccugcucgaaaacgagcggacccuggauuaucaugacuccaaugugaaaaaccuuuacgagaagguccgcagccagcugaaaaacaaugcuaaggaaauugggaacggauguuucgaguuuuaucacaagugcgauaauacauguauggaaucugugaaaaacggcacguacgacuauccuaaguacuccgaggaagccaaacucaauagagaggagaucgaugggguuaagcuggaaagcacccggaucuaucaaauucuugccaucuacucuacaguggcuuccagccugguccucgugguuucccugggcgccauuucuuucuggaugugcagcaacggaucccugcagugccgcaucuguauuuga

SEQ ID NO: 191971 - RNA, 1701 nt, Artificial Sequence; identical to SEQ ID NO: 185693
  derived and/or modified sequence opt5 from hemagglutinin__InfluenzaA__AFK14115

SEQ ID NO: 191972 - RNA, 1701 nt, Artificial Sequence; identical to SEQ ID NO: 185693
  derived and/or modified sequence opt5 from hemagglutinin__InfluenzaA__AFK14131

SEQ ID NO: 191973 - RNA, 1701 nt, Artificial Sequence; identical to SEQ ID NO: 187375
  derived and/or modified sequence opt5 from hemagglutinin__InfluenzaA__AFK14139

SEQ ID NO: 191974 - RNA, 1701 nt, Artificial Sequence
  derived and/or modified sequence opt5 from hemagglutinin__InfluenzaA__AFK14148
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcaaccagcucaagaauaacgccaaggagauugggaauggauguuuugaguucuaucacaaaugcgacaacacauguauggaaucugugaagaauggcaccuacgauuauccuaaauacuccgaagaggcuaagcugaacagagaagagaucgacgggguuaaacuugagagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 191975 - RNA, 1701 nt, Artificial Sequence; identical to SEQ ID NO: 187320
  derived and/or modified sequence opt5 from hemagglutinin__InfluenzaA__AFK14157

SEQ ID NO: 191976 - RNA, 1701 nt, Artificial Sequence; identical to SEQ ID NO: 185693
  derived and/or modified sequence opt5 from hemagglutinin__InfluenzaA__AFK14166

SEQ ID NO: 191977 - RNA, 1701 nt, Artificial Sequence; identical to SEQ ID NO: 187021
  derived and/or modified sequence opt5 from hemagglutinin__InfluenzaA__AFK14175

SEQ ID NO: 191978 - RNA, 1701 nt, Artificial Sequence; identical to SEQ ID NO: 188598
  derived and/or modified sequence opt5 from hemagglutinin__InfluenzaA__AFK14184

SEQ ID NO: 191979 - RNA, 1701 nt, Artificial Sequence; identical to SEQ ID NO: 186046
  derived and/or modified sequence opt5 from hemagglutinin__InfluenzaA__AFK14193

SEQ ID NO: 191980 - RNA, 1701 nt, Artificial Sequence; identical to SEQ ID NO: 187290
  derived and/or modified sequence opt5 from hemagglutinin__InfluenzaA__AFK14202

SEQ ID NO: 191981 - RNA, 1701 nt, Artificial Sequence; identical to SEQ ID NO: 186046
  derived and/or modified sequence opt5 from hemagglutinin__InfluenzaA__AFK14211

SEQ ID NO: 191982 - RNA, 1701 nt, Artificial Sequence
  derived and/or modified sequence opt5 from hemagglutinin__InfluenzaA__AFK14220
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgccucuuccuucgaacgcuaugagaucuuucccaagaccagcucuuggccuaaucacgauuccaacaagggagucacagcugccuguccccaugcgggcgccaagagcuucuacaaaaaucugaucuggcucgugaaaaagggcaacucuuauccuaaacuguccaagagcuacauuaaugacaaggggaaagaaguucuugugcuguggggaauccaccaccccuccaccucugcugaucaacagagccucuaccagaacgccgacgcuuaugucuuugugggcacauccagauacagcaagaaauucaagccugagauugccauccggccgaaagugcgcgaucaggaggggagaaugaauuauuacuggacccuggucgaacccggagacaagauuacguuugaggcgacaggcaaccugguugugccucgguaugccuucgcuauggaacgcaacgccgggucuggaaucauuaucuccgauacccccgugcaugacugcaauacaaccugucaaaccccuaaaggcgcuaucaacacaagccuccccuuucagaauauucacccgaucacgauuggcaagugcccuaaguacgucaaaucuaccaagcugagacuugccacagggcugcggaacgugcccagcauccagucccgcggacucuucggcgccauugcuggguuuaucgagggaggcuggaccgggaugguugacggaugguauggcuaccaucaccagaaugaacaaggcucuggguacgcggccgaucugaaaagcacacagaacgcuaucgacaagauuaccaauaaagugaacuccgucaucgagaagaugaauacgcaguucacagccgugggaaaggaguuuaaccaccuugagaaaagaauugagaaucugaacaagaaaguugaugacggcuuccucgauaucuggaccuauaaugccgaacugcuggugcuccuggagaacgaacggacccuugacuaccaugauagcaaugucaagaaccuguaugagaaagugcgcaaccagcucaagaauaacgcuaaggagauugggaauggauguuucgaauuuuaccacaaaugcgacaacacauguauggagucugucaagaauggcaccuaugauuacccuaaauauuccgaagaggccaagcugaacagagaagagaucgacggggugaaacuugagagcacacggaucuaccaaauucuggcgaucuacucuacgguugcuuccagccucgugcuggucgugucccugggcgccauuucuuucuggaugugcagcaauggaucccuccagugccgcaucuguauuuga

SEQ ID NO: 191983 - RNA, 1701 nt, Artificial Sequence; identical to SEQ ID NO: 187320
  derived and/or modified sequence opt5 from hemagglutinin__InfluenzaA__AFK14229

SEQ ID NO: 191984 - RNA, 1701 nt, Artificial Sequence; identical to SEQ ID NO: 190458
  derived and/or modified sequence opt5 from hemagglutinin__InfluenzaA__AFK14238

SEQ ID NO: 191985 - RNA, 1701 nt, Artificial Sequence
  derived and/or modified sequence opt5 from hemagglutinin__InfluenzaA__AFK14247
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaugaacacaagccuccccuuccagaauauccacccgauuacgaucggcaagugcccuaaguaugugaaaucuaccaagcugagaauggcuacagggcuucggaacguucccagcauucagucccgcggacuguuuggcgccaucgccggguucauugagggaggcuggaccgggaugguggacggaugguacggcuaucaucaccagaaugaacaaggcucuggguacgcugcggaucucaaaagcacacagaacgccaucgacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagauugacgggguuaagcuggaaucuacacggaucuaucaaauccuugccauuuacuccacgguggcgagcucccugguccucgugguuucucugggcgcuaucagcuuuuggaugugcuccaacggaucucugcagugccgcauuuguaucuga

SEQ ID NO: 191986 - RNA, 1701 nt, Artificial Sequence
  derived and/or modified sequence opt5 from hemagglutinin__InfluenzaA__AFK14272
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugacaggaguggcuccccuccaucugggcaaaugcgacauugccggguggauccugggaaacccugagugugaaucucucagcaccgccuccucuuggagcuacauuguugagacguccucuagcgauaauggaaccugcuauccgggggacuuuaucgauuacgaagaacugagagagcagcuuuccagcgugucuuccuucgaacgguuugagaucuuccccaagacaagcucuuggccuaaccacgacuccaauaagggagucaccgccgcuuguccccaugccggcgcgaaaucuuuuuauaagaaccugauuuggcucgugaaaaagggcaauagcuacccuaaacuguccaagagcuauaucaacgauaaggggaaagaaguucuugugcuguggggcauucaccaccccuccacaucugccgaccaacagagccucuaccagaaugcugaugccuacgucuucgugggcaccucccgcuauagcaagaaauuuaagccugagaucgcuauuagaccgaaagugcgggaccaggaggggcgcaugaacuacuauuggacgcuggucgaacccggagauaagaucacauucgaggccaccggcaaucugguugugccuagauacgcguuugccauggaacggaacgcugggucuggaauuaucaucuccgacacacccgugcaugacugcaacaccaccugucaaacaccuaaaggcgccauuaauacgagccuccccuuccagaacauccacccgauuaccaucggcaagugcccuaaguaugucaaaucuacaaagcugcgccuugcuaccgggcugagaaaugugcccagcauucagucccggggacucuuuggcgccaucgccggguucaucgagggaggcuggacagggaugguugauggaugguacggcuaucaucaccagaacgaacaaggcucuggguacgcugcggaccugaaaagcacccagcacgccauugaugagaucacgaauaaggugaacuccgucauugagaaaaugaauacacaguuuaccgcugugggaaaggaguucaaccaucuugagaagcgcaucgaaaaucugaacaaaaagguugacgauggcuuccucgacauuuggaccuacaaugccgagcugcuggugcuccuggaaaacgagagaacacuugauuaucacgacagcaaugucaaaaaccuguacgagaaggugcggucucagcucaaaaauaacgccaaggaaaucgggaacggauguuuugaguucuaucauaagugcgauaauaccuguauggaauccgucaaaaacggcacauacgacuauccuaaguacagcgaggaagcuaaacugaaucgcgaggagaucgauggggugaaacuugaaucuacgagaauuuaucaaauccuggccauuuacuccaccguugcgagcucccucgugcuggucgugucucugggcgcuaucagcuuuuggaugugcuccaacggaucucuccagugccggauuuguaucuga

SEQ ID NO: 191987 - RNA, 1701 nt, Artificial Sequence; identical to SEQ ID NO: 186046
  derived and/or modified sequence opt5 from hemagglutinin__InfluenzaA__AFK14314

SEQ ID NO: 191988 - RNA, 1701 nt, Artificial Sequence
  derived and/or modified sequence opt5 from hemagglutinin__InfluenzaA__AFK14323
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuuauuaacuacgaagaacugcgggagcagcuuagcuccgucagcucuuucgaacgcuuugagaucuuccccaagaccuccagcuggccuaaucacgacucuaacaagggagugacagccgcuuguccccaugccggcgcgaaauccuuuuauaagaaucugaucuggcucguuaaaaagggcaacagcuacccuaaacugucuaaguccuauauuaaugauaaggggaaagaagugcuuguccuguggggaauccaccaccccagcaccuccgccgaccaacagucucucuaccagaacgcugaugccuacguguucgugggcacaagcagauauuccaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggagcggaaucauuaucucugacacccccguccaugauugcaauacaaccugucaaaccccuaaaggcgccaucaacacaucccuccccuuccagaauauucacccgaucacgauuggcaagugcccuaaguaugugaaaagcaccaagcugagacuugcuacagggcugcggaacguucccucuauccagagccgcggacucuuuggcgccauugccggguucaucgagggaggcuggaccgggaugguggacggaugguacggcuaucaucaccagaaugaacaaggcuccggguacgcugcggaccugaaaucuacacagaacgccaucgauaagauuaccaauaaagucaacagcgugaucgagaagaugaauacgcaguuuacagcuguuggaaaggaguucaaccaccuugagaaaagaauugagaaucugaacaagaaaguggacgauggcuuccucgacaucuggaccuacaaugccgaacugcugguccuccuggagaacgaacggacccuugauuaucaugacuccaacgugaagaaucuguacgagaaaguccgcagccagcucaagaacaaugccaaggagauugggaacggauguuuugaguucuaucacaaaugcgauaauacauguauggaaucugugaagaacggcaccuacgacuauccuaaauacuccgaagaggcuaagcugaauagagaagagaucgaugggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 191989 - RNA, 1701 nt, Artificial Sequence; identical to SEQ ID NO: 190458
  derived and/or modified sequence opt5 from hemagglutinin__InfluenzaA__AFK14332

SEQ ID NO: 191990 - RNA, 1701 nt, Artificial Sequence
  derived and/or modified sequence opt5 from hemagglutinin__InfluenzaA__AFK14341
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagaaaacccuugauuaucaugacagcaaugugaagaaccuguacgaaaaaguccggucucagcucaagaacaaugccaaggagauugggaacggauguuuugaguucuaucacaaaugcgauaauacauguauggaauccgugaagaacggcaccuacgacuauccuaaauacagcgaagaggcuaagcugaaucgcgaggaaaucgaugggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 191991 - RNA, 1701 nt, Artificial Sequence; identical to SEQ ID NO: 187113
  derived and/or modified sequence opt5 from hemagglutinin__InfluenzaA__AFK14350

SEQ ID NO: 191992 - RNA, 1701 nt, Artificial Sequence
  derived and/or modified sequence opt5 from hemagglutinin__InfluenzaA__AFK14358
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcgccugcuauccgggggauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgagcaggaagggagaaugaauuacuauuggacacugguugagcccggagauaagauuaccuucgaagcgacgggcaaccugguggugccucgguacgccuuugcuauggagcgcaacgccgggucuggaaucauuaucuccgacacacccguccaugauugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgaaggaggcuggacagggaugguggacggaugguacggcuaucaucaccagaaugagcaaggcucuggguacgcggccgaccugaaaagcacccagaacgcuaucgaugagauuacaaauaaggucaacuccgugaucgagaaaaugaauacccaguuuacggccguuggaaaggaguucaaccaccuugaaaagagaauugagaaucugaacaaaaagguggacgauggcuuccucgacaucuggacauacaaugccgaacugcugguccuccuggagaacgagaaaacccuugauuaucaugacagcaaugugaagaaccuguacgaaaaaguccggucucagcucaagaacaaugcuaaggagauugggaacggauguuuugaguucuaucacaaaugcgauaauaccuguauggaauccgugaagaacggcacauacgacuauccuaaauacagcgaagaggccaagcugaaucgcgaggaaaucgaugggguuaaacuugagucuaccagaaucuaucaaauucuggcgaucuacuccacaguggcuagcucccucguccuggugguuucucugggcgccauuagcuuuuggaugugcuccaacggaucucuccagugccggaucuguauuuga

SEQ ID NO: 191993 - RNA, 1701 nt, Artificial Sequence
  derived and/or modified sequence opt5 from hemagglutinin__InfluenzaA__AFK14395
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgaaaacggcaugugcuguccgcgggacuuuaucgauuaugaggagcuccgcgaacagcuguccagcgucucuuccuucgagagauuugaaaucuuccccaagacgagcucuuggccuaaucacgacuccaacaagggggugaccgccgcuugcccccaugccggagcgaaaucuuuuuacaagaaucuuauuuggcugguuaaaaagggcaacagcuauccuaaacucuccaagagcuacaucaaugauaagggcaaagaggugcugguccuuugggggauucaccaccccuccacaucugccgaccaacagagccuguaucagaacgcugaugccuacguguucgugggauccagccgguacucuaagaaauuuaagccugagaucgcuauucgcccgaaagucagagaccaggaaggccggaugaauuauuacuggacccucguugagcccggggauaagaucacauucgaagccaccggaaaccugguggugccucgcuaugcguuugccauggagagaaacgcuggcuccgggauuaucaucagcgacacgcccguccaugauuguaauacaaccugccaaacaccuaaaggagccauuaacaccucucugcccuuccagaauauccacccgauuaccaucggcaaguguccuaaguacgugaaaagcacaaagcuccggcuggcuacgggccuucgcaacguucccuccauucagucuagagggcuguuuggagccaucgccggcuucaucgaagggggauggaccggcaugguggacgggugguauggauaccaucaccagaaugagcaaggcagcggcuaugcugcggaccucaaauccacacagaacgccauugaugagaucaccaauaaggucaacagcgugauugaaaagaugaauacacaguuuaccgcuguugggaaggaguucaaccaccuggaaaagcggaucgagaaucuuaacaaaaagguggacgauggauuccuggacauuuggacguacaaugccgaacuccugguccugcucgagaacgagcgcacacuggauuaccaugacucuaaugugaaaaaccuuuaugaaaaggucagaucccagcugaaaaacaaugccaaggaggugggcaacgggugcuuugaguucuaccacaagugugauaauaccugcauggaaagcguuaaaaacggaaccuaugacuacccuaaguauucugaagaggcuaaacucaaucgggaggaaaucgauggcgugaagcuggaguccacacgcaucuaccaaauucuugccaucuauagcaccgcggcuuccucucugguccucgugguuagccugggggccauuuccuuuuggaugugcucuaacggcagccugcaguguagaaucugcauuuga

SEQ ID NO: 191994 - RNA, 1701 nt, Artificial Sequence
  derived and/or modified sequence opt5 from hemagglutinin__InfluenzaA__AFK14431
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaacucugacaauggcacgugcuauccgggggauuuucuggacuacgaggaacuucggaagcagcugagcuccgucagcucuuucgagcgcguggaaauuuuucccaagaccuccagcuggccuaaccacgauucuaauaaaggaguuacagccgcuuguccccaugccggcgcgaaguccuucuauaaaaaccucaucuggcuggugaagaaaggcaauagcuacccuaaacuuucuaaguccuauaucaacgacaaggggaaggagguccuggugcucuggggcauucaccaccccagcaccuccgccgaucaacagucucuguaccagaaugcugacgccuacguguuugucggaacaagcagauauuccaaaaaguucaaaccugaaaucgcuauucggccgaagguucgcgaucaggaggggagaaugaacuacuauuggacccugguggagcccggagacaaaaucacguuugaagccacaggcaaccucguggucccucgguacgcguucgccauggagcgcaaugcugggagcggaauuaucauuucugauacccccgugcaugacugcaacacaaccugucaaaccccuaagggcgccaucaauacaucccugcccuuucagaacauccacccgauuacgaucggcaagugcccuaaauauguuaagagcaccaaacuuagacuggcuacagggcuccggaaugugcccucuauucagagccgcggacuguucggcgccaucgccggguuuauugaaggaggcuggaccgggauggucgacggaugguacggcuaucaucaccagaacgagcaaggcuccggguacgcugcggaucuuaagucuacacagaaugccaucgacaaaaucaccaacaaggugaauagcguuauugaaaagaugaacacgcaguucacagcugugggaaaagaguuuaaucaccuggagaagagaaucgaaaaccucaauaaaaaggucgaugacggcuuccuggauauuuggaccuacaacgccgagcugcucgugcugcuugaaaaugagcggacccuggacuaucaugauuccaacgucaaaaaccucuacgaaaaggugcgcagccagcugaagaauaacgccaaagagaucgggaauggauguuucgaguuuuaucacaagugcgacaacacauguauggaaucuguuaaaaauggcaccuacgauuauccuaaguacuccgaggaagcuaaacuuaacagagaggaaauugacggggugaagcuggagagcacacggaucuaucaaauccucgccauuuacucuacggucgcguccagccuggugcugguugugucccucggcgcuaucucuuucuggaugugcagcaauggaucccugcagugccgcauuuguaucuga

SEQ ID NO: 191995 - RNA, 1701 nt, Artificial Sequence; identical to SEQ ID NO: 185693
  derived and/or modified sequence opt5 from hemagglutinin__InfluenzaA__AFK14456

SEQ ID NO: 191996 - RNA, 1701 nt, Artificial Sequence; identical to SEQ ID NO: 185693
  derived and/or modified sequence opt5 from hemagglutinin__InfluenzaA__AFK14465

SEQ ID NO: 191997 - RNA, 1701 nt, Artificial Sequence
  derived and/or modified sequence opt5 from hemagglutinin__InfluenzaA__AFK14536
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuauuccucugacaacggcacgugcuacccgggggauuuuauugacuaugaagaacugcgggagcagcuuagcuccgucagcucuuucgaacgcuuugagaucuuccccaagaccuccagcuggccuaaucacgauucuaacaagggagugacagccgcuuguccccaugccggcgcgaaauccuuuuacaagaaucugaucuggcucguuaaaaagggcaacagcuauccuaaacugucuaaguccuacauuaaugacaaggggaaagaagugcuuguccuguggggaauccaccaccccagcaccuccgccgaucaacagucucucuaccagaacgcugacgccuauguguucgugggcacaagcagauacuccaagaaauuuaagccugagauugcuauccggccgaaaguccgcgaucaggaggggagaaugaauuauuacuggacccugguugaacccggagacaagauuacguucgaggccacaggcaaccugguggugccucgguaugcguuugccauggaacgcaacgcugggagcggaaucauuaucucugauacccccguccaugacugcaauacaaccugucaaaccccuaaaggcgccaucaacacaucccuccccuuccagaauauucacccgaucacgauuggcaagugcccuaaguacgugaaaagcaccaagcugagacuugcuacagggcugcggaacguucccucuauccagagccgcggacucuuuggcgccauugccggguucaucgagggaggcuggaccgggaugguggacggaugguauggcuaccaucaccagaaugaacaaggcuccggguacgcugcggaucugaaaucuacacagcacgccaucgacgagauuaccaacaaggucaauagcgugaucgagaaaaugaacacgcaguuuacagcuguuggaaaggaguucaaucaucuugagaagagaauugaaaaccugaauaaaaagguggaugacggcuuccucgauaucuggaccuauaacgccgagcugcugguccuccuggaaaaugagcggacccuugacuaccacgauuccaacgugaaaaaucuguaugagaagguccgcagccagcucaaaaacaacgccaaggaaauugggaauggauguuuugaguucuaccauaagugcgacaacacauguauggaaucugugaaaaauggcaccuaugauuacccuaaguauuccgaggaagcuaaacugaacagagaggagaucgacgggguuaaacuugaaagcacacggaucuaccaaauucuggccaucuacucuacgguggcguccagccucguccuggugguuucccugggcgcuauuucuuuuuggaugugcagcaauggaucccuccagugccgcaucuguauuuga

SEQ ID NO: 191998 - RNA, 1701 nt, Artificial Sequence; identical to SEQ ID NO: 185693
  derived and/or modified sequence opt5 from hemagglutinin__InfluenzaA__AFK14571

SEQ ID NO: 191999 - RNA, 1701 nt, Artificial Sequence; identical to SEQ ID NO: 190202
  derived and/or modified sequence opt5 from hemagglutinin__InfluenzaA__AFK14586

SEQ ID NO: 192000 - RNA, 1701 nt, Artificial Sequence
  derived and/or modified sequence opt5 from hemagglutinin__InfluenzaA__AFK14595
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugaaaggaguugcuccccuccaucugggcaagugcaacaucgccggguggauucugggaaauccuaagugugagucucucagcacagccuccucuuggagcuacaucggcgaaaccuccucuagcaacaaugggacgugcuauccgggaaacuuuauugacuucgaggaacugaaaaagcagcuuuccagcgugucuuccuuugagagauucgagaucuuucccaaaaccagcucuuggccuaaucacgauuccaacaagggcgucacagccgcuuguccccaugccggcgcgaaaucuuucuacaagaaucugaucuggcucgugaagaaagggaacagcuauccuaagcuguccaaaagcuacauuaaugacaagggaaaagaaguucuugugcuguggggcauccaccaccccuccaccucugccgaucaacagagccucuaucagaacgcugacgccuacgucuuuguggggacaucccgguacagcaagaaauucaagccugagauugcuauccgcccgaaggugagagaucaggaaggacggaugaacuauuacuggacccuggucgagcccggcgacaaaauuacguuugaggccacagggaaucugguugugccucgcuaugcguucgccauggaaagaaacgcuggaucuggcaucauuaucuccgauacccccgugcaugacugcaauacaaccugucaaaccccuaagggcgccaucaacacaagccuccccuuucagaauauucacccgaucacgauugggaaaugcccuaaguacgucaaaucuaccaagcugcggcuugcuacaggacugcgcaacgugcccagcauccaguccagaggccucuucggggccauugccggauuuaucgagggcggguggaccggaaugguugauggcugguauggcuaccaucaccagaaugaacaagggucuggauaugcugcggaccuuaagagcacacagaacgccaucgacgagauuaccaauaaagugaacuccgucaucgaaaagaugaauacgcaguucacagcugugggcaaagaguucaaccaccuggagaagcggauugaaaaucugaacaaaaagguugaugacggguuucucgauaucuggaccuacaaugccgagcugcuggugcuccuggaaaacgagcgcacccuugacuaccaugauagcaacgucaagaaucuguaugaaaaagugagaucucagcucaagaacaaugccaaagagauuggaaacggcuguuucgaguuuuaccacaagugcgacaauacauguauggaauccgucaaaaacgggaccuaugauuacccuaaguauagcgaggaagcuaagcugaaucgggaggaaaucgacggcgugaaacuugagucuacacgcaucuaccaaauucuggccaucuauuccacgguugcgagcucccucgugcuggucgugucucugggagcuauuagcuucuggaugugcuccaacggcucucuccagugcagaaucuguauuuga

SEQ ID NO: 192001 - RNA, 1701 nt, Artificial Sequence; identical to SEQ ID NO: 190202
  derived and/or modified sequence opt5 from hemagglutinin__InfluenzaA__AFK14612

SEQ ID NO: 192002 - RNA, 1701 nt, Artificial Sequence; identical to SEQ ID NO: 185693
  derived and/or modified sequence opt5 from hemagglutinin__InfluenzaA__AFK14621

SEQ ID NO: 192003 - RNA, 1701 nt, Artificial Sequence
  derived and/or modified sequence opt5 from hemagglutinin__InfluenzaA__AFK14630
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccagagccgaucuccaaucuauuaaccagaaugcugacgccuacguguucgugggcacaagccgguacuccaagaaauuuaagccugagaucgcuauucgcccgaaagucagagaucaggaggggcggaugaacuauuacuggacccugguugaacccggagacaagaucacguucgaggccacaggcaaccugguggugccucgcuaugcguuugccauggaaagaaaugcugggagcggaauuaucaucucugauacccccguccaugacugcaacacaaccugucagaccccuaaaggcgccauuaauacaucccuccccuuccaaaacauccacccgauuacgaucggcaagugcccuaaguacgugaaaagcaccaagcugcggcuugcuacagggcugcgcaauguucccucuauucagagcagaggacucuuuggcgccaucgccggguucaucgagggaggcuggaccgggaugguggacggaugguauggcuaccaucaccagaacgaacagggcuccggguaugcugcggaucugaaaucuacacaaaaugccauugacgagaucaccaacaaggucaauagcgugauugagaaaaugaacacgcaguuuacagcuguuggaaaggaguucaaucaccuugagaagcggaucgaaaaccugaauaaaaagguggaugacggcuuccucgauauuuggaccuacaacgccgagcugcugguccuccuggaaaaugagcgcacccuugacuaccaugauuccaacgugaaaaaccuguaugagaaggucagaagccagcucaaaaauaacgccaaggaaaucgggaauggauguuuugaguucuaccacaagugcgacaacacauguauggaaucugugaaaaauggcaccuaugauuacccuaaguauuccgaggaagcuaaacugaaccgggaggagaucgacgggguuaaacuugaaagcacacgcauuuaccagauccuggccauuuauucuacgguggcguccagccucguccuggugguuucccugggcgcuaucucuuuuuggaugugcagcaauggaucccuccaaugcagaauuuguaucuga

SEQ ID NO: 192004 - RNA, 1701 nt, Artificial Sequence
  derived and/or modified sequence opt5 from hemagglutinin__InfluenzaA__AFK14639
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcgggcagcugaaaaacaaugccaaggaaaucggaaacggcuguuuugaguucuaucacaagugcgacaauaccuguauggaauccgugaaaaacgggacauacgauuauccuaaguacagcgaggaagcuaaacucaauagagaggagaucgacggcguuaagcuggaaucuacccggauuuaucaaauccuugccauuuacuccacaguggcgagcucccugguccucgugguuucucugggagcuaucagcuuuuggaugugcuccaacggcucucugcagugccgcauuuguaucuga

SEQ ID NO: 192005 - RNA, 1701 nt, Artificial Sequence; identical to SEQ ID NO: 185693
  derived and/or modified sequence opt5 from hemagglutinin__InfluenzaA__AFK14661

SEQ ID NO: 192006 - RNA, 1701 nt, Artificial Sequence; identical to SEQ ID NO: 190202
  derived and/or modified sequence opt5 from hemagglutinin__InfluenzaA__AFK14670

SEQ ID NO: 192007 - RNA, 1701 nt, Artificial Sequence; identical to SEQ ID NO: 190202
  derived and/or modified sequence opt5 from hemagglutinin__InfluenzaA__AFK14678

SEQ ID NO: 192008 - RNA, 1701 nt, Artificial Sequence
  derived and/or modified sequence opt5 from hemagglutinin__InfluenzaA__AFK14688
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauucacgacgaagaacugcggaagcagcuuuccagcgucucuuccuucgagcgcuuugaaaucuuccccaagaccagcucuuggccuaaucaugauuccaacaaaggagugacagccgcuuguccccacgccggcgccaagagcuuuuacaaaaaucugaucuggcucguuaagaaaggcaacucuuauccuaagcuguccaagagcuacauuaaugacaaagggaaggaggugcuuguccuguggggaauccaccaucccuccaccucugccgaucaacagagccucuaucagaacgcugacgccuacguguucgugggcacauccagauacagcaaaaaguuuaaaccugaaauugcuauccggccgaagguccgcgaucaggaggggagaaugaauuauuacuggacccugguugagcccggagacaaaauuacguucgaagccacaggcaaccugguggugccucgguaugcguuugccauggagcgcaaggcugggucuggaaucauuauccucgauacccccguccacgacuggaacacaaccugcgaaaccccuaagggcgccgugaauacaucccugcccuuccaaaacauccauccgauuacgaucggcaaauguccuaaguacguuaaaagcaccaaacuuagacuggcuacagggcuccggaaugugcccucuauucagagccgcggacuguuuggcgccaucgccggguucauugagggaggcuggaccgggauggucgacggaugguauggcuaccaccaccagaacgaacagggcuccggguaugcugcggaucuuaagucuacacaaaaugccaucgacgagaucaccaacaaggugaauagcguuauugagaagaugaacacgcaguuuacagcugugggaaaagaguucaaucaucuggagaagagaaucgaaaaccucaauaaaaaggucgaugacggcuuccuggauauuuggaccuacaacgccgagcugcucgugcugcuugaaaaugagcggacccuggacuaccacgauuccaacgucaaaaaucucuaugagaaggugcgcagccagcugaagaacaacgccaaagaaaucgggaauggaugcuuugaguucuaccauaagugugacaacacaugcauggaaucuguuaaaaauggcaccuaugauuacccuaaguauuccgaggaagcuaaacuuaacagagaggagauugacggggugaagcuggaaagcacacggaucuaccagauccucgccauuuauucuacggucgcguccagccuggugcugguugugucccucggcgcuaucucuuuuuggauguguagcaauggaucccugcaaugccgcauuugcaucuga

SEQ ID NO: 192009 - RNA, 1701 nt, Artificial Sequence; identical to SEQ ID NO: 190202
  derived and/or modified sequence opt5 from hemagglutinin__InfluenzaA__AFK14697

SEQ ID NO: 192010 - RNA, 1701 nt, Artificial Sequence; identical to SEQ ID NO: 190202
  derived and/or modified sequence opt5 from hemagglutinin__InfluenzaA__AFK14713

SEQ ID NO: 192011 - RNA, 1701 nt, Artificial Sequence; identical to SEQ ID NO: 190202
  derived and/or modified sequence opt5 from hemagglutinin__InfluenzaA__AFK14722

SEQ ID NO: 192012 - RNA, 1701 nt, Artificial Sequence
  derived and/or modified sequence opt5 from hemagglutinin__InfluenzaA__AFK14731
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcggaagcagcuuuccagcgucucuuccuucgagcgcguggaaaucuuucccaagaccagcucuuggccuaaucacgauuccaacaaaggaguuacagccgcuuguccccaugccggcgccaagagcuucuauaaaaaucugaucuggcucgugaagaaaggcaacucuuacccuaagcuguccaagagcuauauuaaugacaaagggaaggagguccuugugcuguggggaauccaccaccccuccaccucugccgaucaacagagccucuaccagaacgcugacgccuacguguuugucggcacauccagauauagcaaaaaguucaaaccugaaauugcuauccggccgaagguucgcgaucaggaggggagaaugaauuacuauuggacccugguggagcccggagacaaaauuacguuugaagccacaggcaaccugguggucccucgguacgcguucgccauggagcgcaacgcugggucuggaaucauuaucuccgauacccccgugcaugacugcaauacaaccugucaaaccccuaagggcgccguuaacacaagccuccccuuucagaauauccacccgauuacgaucggcaagugcccuaaauaugugaagucuaccaaacugagacuugcuacagggcugcggaacguccccagcauucagucccgcggacucuucggcgccaucgccggguuuauugaaggaggcuggaccgggaugguggacggaugguacggcuaucaucaccagaaugagcaaggcucuggguacgcugcggaucuuaagagcacacagaacgccaucgacgaaaucaccaauaaaguuaacuccgugauugagaagaugaauacgcaguucacagcugucggaaaggaguuuaaccaccuggagaaaagaaucgagaaucugaacaagaaaguggaugacggcuuccucgauauuuggaccuacaaugccgaacugcugguccuccuggagaacgaacggacccuugacuaucaugauagcaaugugaagaaccuguacgagaaaguucgcucucagcucaagaacaaugccaaggagaucgggaacggauguuucgaauuuuaucacaaaugcgacaauacauguauggaguccgugaagaacggcaccuacgauuauccuaaauacagcgaagaggcuaagcugaauagagaagagauugacggggucaaacuugagucuacacggaucuaucaaauccuggccauuuacuccacgguggcgagcucccucguucugguggucucucugggcgcuaucagcuucuggaugugcuccaacggaucucuccagugccgcauuuguaucuga

SEQ ID NO: 192013 - RNA, 1701 nt, Artificial Sequence; identical to SEQ ID NO: 190202
  derived and/or modified sequence opt5 from hemagglutinin__InfluenzaA__AFK14740

SEQ ID NO: 192014 - RNA, 1701 nt, Artificial Sequence; identical to SEQ ID NO: 190202
  derived and/or modified sequence opt5 from hemagglutinin__InfluenzaA__AFK14749

SEQ ID NO: 192015 - RNA, 1701 nt, Artificial Sequence; identical to SEQ ID NO: 190202
  derived and/or modified sequence opt5 from hemagglutinin__InfluenzaA__AFK14756

SEQ ID NO: 192016 - RNA, 1701 nt, Artificial Sequence; identical to SEQ ID NO: 190202
  derived and/or modified sequence opt5 from hemagglutinin__InfluenzaA__AFK14764

SEQ ID NO: 192017 - RNA, 1701 nt, Artificial Sequence
  derived and/or modified sequence opt5 from hemagglutinin__InfluenzaA__AFK14779
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugggaggcguugcuccccuccaucuggggaaaugcaacaucgccggauggauucugggcaauccugagugugaaucucucagcacagccuccucuuggagcuacaucguggagaccuccucuagcgacaacgggacgugcuauccgggaaauuuuauugauuacgaagaacugagagagcagcuuuccagcgucucuuccuucgaacgguuugagaucuuccccaagaccagcucuuggccuaaccacgacuccaauaagggcgugacagccgcuuguccccaugccggcgcgaaaucuuuuuauaagaaccugaucuggcucguuaaaaaggggaauagcuacccuaaacuguccaagagcuauauuaacgauaagggaaaagaagugcuuguccuguggggcauccaccaccccuccaccucugccgaccaacagagccucuaccagaaugcugaugccuacguguucguggggacaucccgcuauagcaagaaauuuaagccugagauugcuaucagaccgaaaguccgggaccaggagggacgcaugaacuacuauuggacccugguugaacccggcgauaagauuacguucgaggccacagggaaccugguggugccuagauacgcguuugccauggaacggaaugcuggaucuggcaucauuaucuccgacacccccguccaugauugcaacacaaccugucaaaccccuaaaggcgccaucaauacaagccuccccuuccagaacauucacccgaucacgauugggaagugcccuaaguaugugaaaucuaccaagcugcgccuugcuacaggacugagaaauguucccagcauccagucccggggccucuuuggggccauugccggauucaucgagggcggguggaccggaaugguggacggcugguacggcuaucaucaccagaacgaacaagggucuggauacgcugcggaccugaaaagcacacagaaugccaucgaugagauuaccaacaaggucaauuccgugaucgagaaaaugaacacgcaguuuacagcuguuggcaaggaguucaaucaccuugagaagcgcauugaaaaccugaauaaaaagguggacgauggguuccucgacaucuggaccuacaacgccgagcugcugguccuccuggaaaaugagagaacccuugauuaucaugacagcaacgugaaaaaccuguacgagaagguccggucucagcucaaaaauaacgccaaggaaauuggaaauggcuguuuugaguucuaucacaagugcgauaacacauguauggaauccgugaaaaaugggaccuacgacuauccuaaguacagcgaggaagcuaaacugaaccgcgaggagaucgauggcguuaaacuugaaucuacaagaaucuaucaaauucuggccaucuacuccacgguggcgagcucccucguccuggugguuucucugggagcuauuagcuuuuggaugugcuccaauggcucucuccagugccggaucuguauuuga

SEQ ID NO: 192018 - RNA, 1701 nt, Artificial Sequence
  derived and/or modified sequence opt5 from hemagglutinin__InfluenzaA__AFK14788
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucagaaaguccuauaucaaugacaaggggaaagaagugcugguccuuuggggcauucaccaccccagcaccuccgccgaucaacagucucuguaccagaacgcugacgccuacguguucgugggaagcucccgguauagcaagaaauuuaagccugagaucgcuauucgcccgaaagucagagaucaggaggggcggaugaauuacuauuggacacucguugaacccggagacaagaucaccuucgaggccacgggcaaccugguggugccucgcuacgcguuugccauggaaagaaacgcugggucuggaauuaucaucuccgauacacccguccaugacugcaauaccacaugucaaaccccuaaaggcgccauuaacaccagccugcccuuccagaauauccacccgauuacaaucggcaagugcccuaaguaugugaaaucuacgaagcuccggcuggcuaccgggcuucgcaacguucccagcauucaguccagaggacuguuuggcgccaucgccggguucaucgagggaggcuggacagggaugguggacggaugguacggcuaucaucaccagaaugaacaaggcucuggguacgcugcggaucucaaaagcacccagaacgccauugacgagaucacaaauaaggucaacuccgugauugagaaaaugaauacccaguuuacggcuguuggaaaggaguucaaccaccuggagaagcggaucgaaaaucuuaacaaaaagguggaugacggcuuccuggauauuuggacauacaaugccgagcuccugguccugcucgaaaacgagcgcacccuggacuaucaugauagcaaugugaaaaaccuuuacgagaaggucagaucucagcugaaaaacaaugccaaggaaguggggaacggauguuuugaguucuaucacaagugcgacaauaccuguauggaauccguuaaaaacggcacauacgauuauccuaaguacagcgaggaagcuaaacucaaucgggaggagaucgacggggugaagcuggaaucuacccgcaucuaucaaauucuugccaucuacuccacagcggcuagcucccugguccucgugguuucucugggcgccauuagcuuuuggaugugcuccaacggaucucugcagugcagaaucuguauuuga

SEQ ID NO: 192019 - RNA, 1701 nt, Artificial Sequence
  derived and/or modified sequence opt5 from hemagglutinin__InfluenzaA__AFK14798
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaggaacugcggaagcagcuuuccagcgucucuuccuucgagcgcguggaaaucuuucccaagaccagcucuuggccuaaccacgacuccaauaaaggaguuacagccgcuuguccccaugccggcgccaagagcuucuauaaaaaccugaucuggcucgugaagaaaggcaauucuuacccuaagcuguccaagagcuauauuaacgauaaagggaaggagguccuugugcuguggggaauccaccaccccuccaccucugccgaccaacagagccucuaccagaaugcugaugccuacguguuugucggcacauccagauauagcaaaaaguucaaaccugaaauugcuauccggccgaagguucgcgaccaggaggggagaaugaacuacuauuggacccugguggagcccggagauaaaauuacguuugaagccacaggcaaccugguggucccucgguacgcguucgccauggagcgcaaugcugggucuggaaucauuaucuccgacacccccgugcaugauugcaacacaaccugucaaaccccuaauggcgccaucaacacaagccuccccuuucagaauauucacccgaucacgauuggcaagugcccuaaguauguuaaaucuaccaagcugagacuugcuacagggcugcggaacgugcccagcauccagucccgcggacucuucggcgccauugccggguuuaucgaaggaggcuggaccgggauggucgacggaugguacggcuaucaucaccagaaugagcaaggcucuggguacgcugcggaccugaaaagcacacagaacgccaucgauaagauuaccaauaaagugaacuccguuaucgaaaagaugaauacgcaguucacagcugugggaaaggaguuuaaccaccuugagaaaagaauugaaaaucugaacaagaaagucgacgauggcuuccucgacaucuggaccuacaaugccgagcugcuggugcuccuggaaaacgagcggacccuugauuaucaugacagcaacgucaagaaucuguacgaaaaagugcgcucucagcucaagaacaaugccaaggagauugggaacggauguuucgaguuuuaucacaaaugcgauaauacauguauggaauccguuaagaacggcaccuacgacuauccuaaauacagcgaggaagcuaagcugaauagagaggaaaucgauggggugaaacuugagucuacacggaucuaucaaauucuggccaucuacuccacggucgcgagcucccucgugcugguugugucucugggcgcuauuagcuucuggaugugcuccaacggaucucuccagugccgcaucuguauuuga

SEQ ID NO: 192020 - RNA, 1701 nt, Artificial Sequence
  derived and/or modified sequence opt5 from hemagglutinin__InfluenzaA__AFK14814
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuaugaacgcuacgagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuacauuaaugacaaggggaaagaagugcuuguccuguggggaauccaccaccccuccaccucugccgaucaacagagccucuaucagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaccaucaccagaaugagcaaggcucuggguaugcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuucucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuucgaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaccaaauucuggccaucuauuccacgguggcgagcucccucguccuggugguuucucugggcgcuauuagcuuuuggaugugcuccaacggaucucuccagugccgcaucuguauuuga

SEQ ID NO: 192021 - RNA, 1701 nt, Artificial Sequence
  derived and/or modified sequence opt5 from hemagglutinin__InfluenzaA__AFK14831
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuuccgacuacgaagaacugcgggagcagcuuagcucugucuccagcuucgaacgcuuugagauuuuccccaagaccucuuccuggccuaaucacgauagcaacaagggagugacagccgcuuguccccaugccggcgcgaaaucuuuuuauaagaaucugaucuggcucguuaaaaagggcaacuccuacccuaaacugagcaaguccuauaucaaugacaaggggaaagaagugcuuguccuguggggcauucaccaccccucuaccagcgccgaucaacagucccucuaccagaacgcugacgccuacguguucgugggaacaagcagauauucuaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcuggguccggaauuaucauuagcgauacccccguccaugacugcaauacaaccugucaaaccccuaaaggcgccaucaacacaucucuccccuuccagaauauccacccgauuacgaucggcaagugcccuaaguaugugaaaagcaccaagcugagacuugcuacagggcugcggaacguucccuccauucagucucgcggacucuuuggcgccaucgccggguucauugagggaggcuggaccgggaugguggacggaugguacggcuaucaucaccagaaugaacaaggcagcggguacgcugcggaucugaaauccacacagaacgccaucgacgagaucaccaauaaggucaacagcgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauucuaaugugaaaaaccuguacgagaagguccgcucccagcucaaaaacaaugccaaggaaaucgggaacggauguuuugaguucuaucacaagugcgacaauacauguauggaaagcgugaaaaacggcaccuacgauuauccuaaguacucugaggaagcuaaacugaauagagaggagauugacgggguuaaacuugaauccacacggaucuaucaaauccuggccauuuacagcacgguggcguccucucucguccuggugguuagccugggcgcuaucuccuuuuggaugugcucuaacggaagccuccagugccgcauuuguaucuga

SEQ ID NO: 192022 - RNA, 1701 nt, Artificial Sequence; identical to SEQ ID NO: 185693
  derived and/or modified sequence opt5 from hemagglutinin__InfluenzaA__AFK14839

SEQ ID NO: 192023 - RNA, 1701 nt, Artificial Sequence
  derived and/or modified sequence opt5 from hemagglutinin__InfluenzaA__AFK14847
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgccucuuccuucgaacgcuaugagaucuuucccaagaccagcucuuggccuaaucacgauuccaacaagggagucacagcugccuguccccaugcgggcgccaagagcuucuacaagaaucugaucuggcucgugaaaaagggcaacucuuauccuaaacuguccaagagcuacauuaaugacaaggggaaagaaguucuugugcuguggggaauccaccaccccuccaccucugcugaucaacagagccucuaccagaacgccgacgcuuaugucuuugugggcacauccagauacagcaagaaauucaagccugagauugccauccggccgaaagugcgcgaucaggaggggagaaugaauuauuacuggacccuggucgaacccggagacaagauuacguuugaggcgacaggcaaccugguugugccucgguaugccuucgcuauggaacgcaacgccgggucuggaaucauuaucuccgauacccccgugcaugacugcaauacaaccugucaaaccccuaaaggcgcuaucaacacaagccuccccuuucagaauauucacccgaucacgauuggcaagugcccuaaguacgucaaaucuaccaagcugagacuugccacagggcugcggaacgugcccagcauccagucccgcggacucuucggcgccauugcuggguuuaucgagggaggcuggaccgggaugguugacggaugguauggcuaccaucaccagaaugaacaaggcucuggguacgcggccgaucugaaaagcacacagaacgcuaucgacgagauuaccaauaaggugaacuccgucaucgagaaaaugaauacgcaguucacagccgugggaaaggaauuuaaccaccuugagaagagaauugaaaaucugaacaaaaagguugaugacggcuuccucgauaucuggaccuauaaugccgagcugcuggugcuccuggaaaacgagcggacccuugacuaccaugauagcaaugucaaaaaccuguaugagaaggugcgcucucagcucaaaaacaaugcuaaggaaauugggaacggauguuucgaguuuuaccacaagugcgacaauacauguauggaauccgucaaaaacggcaccuaugauuacccuaaguauagcgaggaagccaaacugaauagagaggagaucgacggggugaaacuugaaucuacacggaucuaccaaauucuggcgaucuacuccacgguugcuagcucccucgugcuggucgugucucugggcgccauuagcuucuggaugugcuccaacggaucucuccagugccgcaucuguauuuga

SEQ ID NO: 192024 - RNA, 1701 nt, Artificial Sequence; identical to SEQ ID NO: 190202
  derived and/or modified sequence opt5 from hemagglutinin__InfluenzaA__AFK14868

SEQ ID NO: 192025 - RNA, 1701 nt, Artificial Sequence; identical to SEQ ID NO: 186857
  derived and/or modified sequence opt5 from hemagglutinin__InfluenzaA__AFK14884

SEQ ID NO: 192026 - RNA, 1701 nt, Artificial Sequence; identical to SEQ ID NO: 186857
  derived and/or modified sequence opt5 from hemagglutinin__InfluenzaA__AFK14892

SEQ ID NO: 192027 - RNA, 1701 nt, Artificial Sequence; identical to SEQ ID NO: 186857
  derived and/or modified sequence opt5 from hemagglutinin__InfluenzaA__AFK14901

SEQ ID NO: 192028 - RNA, 1701 nt, Artificial Sequence; identical to SEQ ID NO: 186857
  derived and/or modified sequence opt5 from hemagglutinin__InfluenzaA__AFK14910

SEQ ID NO: 192029 - RNA, 1701 nt, Artificial Sequence; identical to SEQ ID NO: 185693
  derived and/or modified sequence opt5 from hemagglutinin__InfluenzaA__AFK14919

SEQ ID NO: 192030 - RNA, 1701 nt, Artificial Sequence; identical to SEQ ID NO: 185693
  derived and/or modified sequence opt5 from hemagglutinin__InfluenzaA__AFK14929

SEQ ID NO: 192031 - RNA, 1701 nt, Artificial Sequence; identical to SEQ ID NO: 191210
  derived and/or modified sequence opt5 from hemagglutinin__InfluenzaA__AFK25599

SEQ ID NO: 192032 - RNA, 1701 nt, Artificial Sequence
  derived and/or modified sequence opt5 from hemagglutinin__InfluenzaA__AFK25601
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugugacacucucuaccgccagcuccuggucuuacaucgucgaaacgagcuccucugacaacgggaccugcuauccgggcgauuuuauugacuacgaggaacugcgggagcagcuuagcuccgugagcucuuucgagcgcuuugaaaucuuccccaagacauccagcuggccuaaucacgauucuaacaagggaguuaccgccgcuuguccccaugccggcgcgaaaggcuuuuauaagaaucugaucuggcucgugaaaaaggggaacuccuacccuaaacugagcaagucuuauauuaaugacaagggaaaagagguccuugugcuguggggcauccaccaccccuccacaaccgccgaucaacagagccucuaccagaacgcugacacguacguguucgucgggacauccagauauucuaagaaauuuaagccugaaauugccauccggccgaaaguucgcgaucaggagggaagaaugaauuacuauuggacccugguggagcccggcgacaagauuacauucgaagcuaccgggaaccugguggucccucgguacgccuuugcgauggagcgcgaugccggaagcggcaucauuaucuccgacacccccgugcaugacugcaacacaacgugucaaaccccuaaaggcgcuaucaauacaagccuccccuuccagaacauucacccgaucaccauugggaagugcccuaaguauguuaaaucuacaaagcugagacuugccaccggacugcggaaugugcccuccauccagagccgcggccucuuuggggcuauugccggauucaucgaaggcggguggacgggaauggucgauggcugguacggcuaucaucaccagaacgagcaagggucuggauacgccgcugaccugaaaagcacacagaaugcgaucgauaagauuaccaacaaaguuaauuccgugaucgaaaagaugaacacccaguuuacagccgugggcaaggaguucaaucaccuugagaaaagaauugaaaaccugaauaagaaagucgacgauggguuccucgacaucuggaccuacaacgcugagcugcuggugcuccuggaaaaugagcggacacuugauuaucaugacucuaacgucaagaaucuguacgaaaaagugcgcaaccagcucaagaacaaugccaaggagauuggaaacggcuguuuugaguucuaucacaaaugcgauaauacguguauggaaagcguuaagaacgggaccuacgacuauccuaaauacuccgaggaagccaagcugaauagagaggaaaucgauggcgugaaacuugagagcacacggaucuaucaaauucuggcuaucuacucuaccgccgcguccagccucguccuggugguuucucugggagcuauuuccuuuuggaugugcagcaacggcucccuccagugccgcaucuguauuuga

SEQ ID NO: 192033 - RNA, 1701 nt, Artificial Sequence; identical to SEQ ID NO: 191210
  derived and/or modified sequence opt5 from hemagglutinin__InfluenzaA__AFK25603

SEQ ID NO: 192034 - RNA, 1701 nt, Artificial Sequence
  derived and/or modified sequence opt5 from hemagglutinin__InfluenzaA__AFK25605
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaacacucucuaccgccagcuccuggucuuacaucguggagacgagcuccucugacaacgggaccugcuauccgggcgauuuuauugacuacgaagaacugcgggagcagcuuagcuccgucagcucuuucgaacgcuuugagaucuuccccaagacauccagcuggccuaaucacgauucuaacaagggagugaccgccgcuuguccccaugccggcgcgaaaggcuuuuauaagaaucugaucuggcucguuaaaaaggggaacuccuacccuaaacugagcaagucuuauauuaaugacaagggaaaagaagugcuuguccuguggggcauccaccaccccuccacaaccgccgaucaacagagccucuaccagaacgcugacacguacguguucguggggacauccagauauucuaagaaauuuaagccugagauugccauccggccgaaaguccgcgaucaggagggaagaaugaauuacuauuggacccugguugaacccggcgacaagauuacauucgaggcuaccgggaaccugguggugccucgguacgccuuugcgauggaacgcgaugccggaagcggcaucauuaucuccgacacccccguccaugacugcaacacaacgugucaaaccccuaaaggcgcuaucaauacaagccuccccuuccagaacauucacccgaucaccauugggaagugcccuaaguaugugagaucuacaaaacugcggcuugccaccggacugcgcaauguucccuccauccagagcagaggccucuuuggggcuauugccggauucaucgagggcggguggacgggaaugguggauggcugguacggcuaucaucaccagaacgaacaagggucuggauacgccgcugaccuuaagagcacacagaaugcgaucgauaaaauuaccaacaaggucaauuccgugaucgagaaaaugaacacccaguuuacagccguuggcaaggaguucaaucaccuugaaaagcggauugagaaccugaauaaaaagguggacgauggguuccucgacaucuggaccuacaacgcugaacugcugguccuccuggagaaugaacgcacacuugauuaucaugacucuaacgugaaaaaucuguacgagaaggucagaaaccagcucaaaaacaaugccaaggagauuggaaacggcuguuuugaguucuaucacaagugcgauaauacguguauggagagcgugaaaaacgggaccuacgacuauccuaaguacuccgaagaggccaaacugaaucgggaagagaucgauggcguuaagcuggagagcacacgcaucuaucaaauucuggcuaucuacucuaccgccgcguccagccucgugcuggucgugucucugggagcuauuuccuuuuggaugugcagcaacggcucccuccagugcagaaucuguauuuga

SEQ ID NO: 192035 - RNA, 1701 nt, Artificial Sequence; identical to SEQ ID NO: 191438
  derived and/or modified sequence opt5 from hemagglutinin__InfluenzaA__AFK74526

SEQ ID NO: 192036 - RNA, 1701 nt, Artificial Sequence; identical to SEQ ID NO: 185693
  derived and/or modified sequence opt5 from hemagglutinin__InfluenzaA__AFK74534

SEQ ID NO: 192037 - RNA, 1701 nt, Artificial Sequence; identical to SEQ ID NO: 185693
  derived and/or modified sequence opt5 from hemagglutinin__InfluenzaA__AFK74544

SEQ ID NO: 192038 - RNA, 1701 nt, Artificial Sequence; identical to SEQ ID NO: 185693
  derived and/or modified sequence opt5 from hemagglutinin__InfluenzaA__AFK74554

SEQ ID NO: 192039 - RNA, 1701 nt, Artificial Sequence; identical to SEQ ID NO: 185935
  derived and/or modified sequence opt5 from hemagglutinin__InfluenzaA__AFK74564

SEQ ID NO: 192040 - RNA, 1701 nt, Artificial Sequence; identical to SEQ ID NO: 188248
  derived and/or modified sequence opt5 from hemagglutinin__InfluenzaA__AFK74575

SEQ ID NO: 192041 - RNA, 1701 nt, Artificial Sequence; identical to SEQ ID NO: 185680
  derived and/or modified sequence opt5 from hemagglutinin__InfluenzaA__AFK74585

SEQ ID NO: 192042 - RNA, 1701 nt, Artificial Sequence
  derived and/or modified sequence opt5 from hemagglutinin__InfluenzaA__AFK74595
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucugaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccaugacugcaauacaaccugucaaaccccuaaaggcgccaucaacacaucccugcccuuccagaauauucacccgaucacgauuggcaagugcccuaaguaugugaaaagcaccaaacuuagacuggcuacagggcuccggaacguucccucuauccagagccgcggacuguuuggcgccauugccggguucaucgagggaggcuggaccgggaugguggacggaugguacggcuaucaucaccagaaugaacaaggcuccggguacgcugcggaucuuaagucuacacagaacgccaucgacgagauuaccaauaaggucaacagcgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauuccaaugugaaaaaccucuacgagaagguccgcagccagcugaaaaacaaugccaaggaaauugggaacggauguuuugaguucuaucacaagugcgacaauacauguauggaaucugugaaaaacggcaccuacgauuauccuaaguacuccgaggaagcuaaacuuaauagagaggagaucgacgggguuaagcuggaaagcacacggaucuaucaaauucucgccaucuacucuacgguggcguccagccugguccuggugguuucccucggcgcuauuucuuuuuggaugugcagcaacggaucccugcagugccgcaucuguauuuga

SEQ ID NO: 192043 - RNA, 1701 nt, Artificial Sequence; identical to SEQ ID NO: 185693
  derived and/or modified sequence opt5 from hemagglutinin__InfluenzaA__AFK74605

SEQ ID NO: 192044 - RNA, 1701 nt, Artificial Sequence; identical to SEQ ID NO: 185935
  derived and/or modified sequence opt5 from hemagglutinin__InfluenzaA__AFK74615

SEQ ID NO: 192045 - RNA, 1701 nt, Artificial Sequence; identical to SEQ ID NO: 185935
  derived and/or modified sequence opt5 from hemagglutinin__InfluenzaA__AFK74625

SEQ ID NO: 192046 - RNA, 1701 nt, Artificial Sequence; identical to SEQ ID NO: 186795
  derived and/or modified sequence opt5 from hemagglutinin__InfluenzaA__AFK74635

SEQ ID NO: 192047 - RNA, 1701 nt, Artificial Sequence; identical to SEQ ID NO: 186795
  derived and/or modified sequence opt5 from hemagglutinin__InfluenzaA__AFK74645

SEQ ID NO: 192048 - RNA, 1701 nt, Artificial Sequence; identical to SEQ ID NO: 185693
  derived and/or modified sequence opt5 from hemagglutinin__InfluenzaA__AFK74655

SEQ ID NO: 192049 - RNA, 1701 nt, Artificial Sequence; identical to SEQ ID NO: 185693
  derived and/or modified sequence opt5 from hemagglutinin__InfluenzaA__AFK74665

SEQ ID NO: 192050 - RNA, 1701 nt, Artificial Sequence; identical to SEQ ID NO: 185693
  derived and/or modified sequence opt5 from hemagglutinin__InfluenzaA__AFK74675

SEQ ID NO: 192051 - RNA, 1701 nt, Artificial Sequence; identical to SEQ ID NO: 185693
  derived and/or modified sequence opt5 from hemagglutinin__InfluenzaA__AFK74685

SEQ ID NO: 192052 - RNA, 1701 nt, Artificial Sequence; identical to SEQ ID NO: 188248
  derived and/or modified sequence opt5 from hemagglutinin__InfluenzaA__AFK74695

SEQ ID NO: 192053 - RNA, 1701 nt, Artificial Sequence; identical to SEQ ID NO: 185693
  derived and/or modified sequence opt5 from hemagglutinin__InfluenzaA__AFK74705

SEQ ID NO: 192054 - RNA, 1701 nt, Artificial Sequence; identical to SEQ ID NO: 185693
  derived and/or modified sequence opt5 from hemagglutinin__InfluenzaA__AFK74715

SEQ ID NO: 192055 - RNA, 1701 nt, Artificial Sequence; identical to SEQ ID NO: 185693
  derived and/or modified sequence opt5 from hemagglutinin__InfluenzaA__AFK74725

SEQ ID NO: 192056 - RNA, 1701 nt, Artificial Sequence; identical to SEQ ID NO: 185693
  derived and/or modified sequence opt5 from hemagglutinin__InfluenzaA__AFK74735

SEQ ID NO: 192057 - RNA, 1701 nt, Artificial Sequence; identical to SEQ ID NO: 185693
  derived and/or modified sequence opt5 from hemagglutinin__InfluenzaA__AFK74745

SEQ ID NO: 192058 - RNA, 1701 nt, Artificial Sequence; identical to SEQ ID NO: 185693
  derived and/or modified sequence opt5 from hemagglutinin__InfluenzaA__AFK74755

SEQ ID NO: 192059 - RNA, 1701 nt, Artificial Sequence; identical to SEQ ID NO: 188248
  derived and/or modified sequence opt5 from hemagglutinin__InfluenzaA__AFK74765

SEQ ID NO: 192060 - RNA, 1701 nt, Artificial Sequence; identical to SEQ ID NO: 185693
  derived and/or modified sequence opt5 from hemagglutinin__InfluenzaA__AFK74775

SEQ ID NO: 192061 - RNA, 1701 nt, Artificial Sequence; identical to SEQ ID NO: 185693
  derived and/or modified sequence opt5 from hemagglutinin__InfluenzaA__AFK74785

SEQ ID NO: 192062 - RNA, 1701 nt, Artificial Sequence; identical to SEQ ID NO: 185693
  derived and/or modified sequence opt5 from hemagglutinin__InfluenzaA__AFK74795

SEQ ID NO: 192063 - RNA, 1701 nt, Artificial Sequence; identical to SEQ ID NO: 185693
  derived and/or modified sequence opt5 from hemagglutinin__InfluenzaA__AFK74805

SEQ ID NO: 192064 - RNA, 1701 nt, Artificial Sequence; identical to SEQ ID NO: 185693
  derived and/or modified sequence opt5 from hemagglutinin__InfluenzaA__AFK74815

SEQ ID NO: 192065 - RNA, 1701 nt, Artificial Sequence; identical to SEQ ID NO: 185693
  derived and/or modified sequence opt5 from hemagglutinin__InfluenzaA__AFK74825

SEQ ID NO: 192066 - RNA, 1701 nt, Artificial Sequence; identical to SEQ ID NO: 185693
  derived and/or modified sequence opt5 from hemagglutinin__InfluenzaA__AFK74835

SEQ ID NO: 192067 - RNA, 1701 nt, Artificial Sequence; identical to SEQ ID NO: 185693
  derived and/or modified sequence opt5 from hemagglutinin__InfluenzaA__AFK74845

SEQ ID NO: 192068 - RNA, 1701 nt, Artificial Sequence; identical to SEQ ID NO: 185693
  derived and/or modified sequence opt5 from hemagglutinin__InfluenzaA__AFK74895

SEQ ID NO: 192069 - RNA, 1701 nt, Artificial Sequence; identical to SEQ ID NO: 185693
  derived and/or modified sequence opt5 from hemagglutinin__InfluenzaA__AFK74905

SEQ ID NO: 192070 - RNA, 1701 nt, Artificial Sequence; identical to SEQ ID NO: 185693
  derived and/or modified sequence opt5 from hemagglutinin__InfluenzaA__AFK74915

SEQ ID NO: 192071 - RNA, 1701 nt, Artificial Sequence
  derived and/or modified sequence opt5 from hemagglutinin__InfluenzaA__AFK74925
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugugccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagcugccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuuaccauggaacgcaacgcggggucuggaaucauuaucuccgauacacccgugcaugacugcaauaccaccugucaaacaccuaaaggcgccaucaacacgagccuccccuuccagaauauucacccgaucaccauuggcaagugcccuaaguauguuaaaucuacaaagcugagacuugcuaccgggcugcggaacgugcccagcauccagucccgcggacucuuuggcgccauugcuggguucaucgagggaggcuggacagggauggucgacggaugguacggcuaucaucaccagaaugaacaaggcucuggguacgccgccgaucugaaaagcacccagaacgcuaucgacggaauuacgaauaaggugaacuccguuaucgagaaaaugaauacacaguuuaccgcggugggcaaggaguucaaccaccuugaaaagagaauugagaaucugaacaaaaagaucgaugacggguuccucgauauuuggaccuacaaugccgaacugcugguccuccuggagaacgaacggacacuugacuaucaugauagcaaugugaaaaaccuguacgagaagguccgcucucagcucaaaaacaaugcuaaggagaucggaaacggcuguuuugaguucuaucacaagugcgacaauaccuguauggaguccgugaaaaacgggacauacgauuauccuaaguacagcgaagaggccaaacugaauagagaagagaucgacggcguuaaacuugagucuacgcggauuuaucaaauccuggccauuuacuccaccguggcuagcucccucguccuggugguuucucugggagccaucagcuuuuggaugugcuccaacggcucucuccagugccgcauuuguaucuga

SEQ ID NO: 192072 - RNA, 1701 nt, Artificial Sequence; identical to SEQ ID NO: 186795
  derived and/or modified sequence opt5 from hemagglutinin__InfluenzaA__AFK74935

SEQ ID NO: 192073 - RNA, 1701 nt, Artificial Sequence; identical to SEQ ID NO: 185693
  derived and/or modified sequence opt5 from hemagglutinin__InfluenzaA__AFK74945

SEQ ID NO: 192074 - RNA, 1701 nt, Artificial Sequence; identical to SEQ ID NO: 185693
  derived and/or modified sequence opt5 from hemagglutinin__InfluenzaA__AFK74955

SEQ ID NO: 192075 - RNA, 1701 nt, Artificial Sequence; identical to SEQ ID NO: 185693
  derived and/or modified sequence opt5 from hemagglutinin__InfluenzaA__AFK74965

SEQ ID NO: 192076 - RNA, 1701 nt, Artificial Sequence; identical to SEQ ID NO: 185784
  derived and/or modified sequence opt5 from hemagglutinin__InfluenzaA__AFK74975

SEQ ID NO: 192077 - RNA, 1701 nt, Artificial Sequence; identical to SEQ ID NO: 185693
  derived and/or modified sequence opt5 from hemagglutinin__InfluenzaA__AFK74985

SEQ ID NO: 192078 - RNA, 1701 nt, Artificial Sequence; identical to SEQ ID NO: 188248
  derived and/or modified sequence opt5 from hemagglutinin__InfluenzaA__AFK74995

SEQ ID NO: 192079 - RNA, 1701 nt, Artificial Sequence; identical to SEQ ID NO: 185693
  derived and/or modified sequence opt5 from hemagglutinin__InfluenzaA__AFK75005

SEQ ID NO: 192080 - RNA, 1701 nt, Artificial Sequence
  derived and/or modified sequence opt5 from hemagglutinin__InfluenzaA__AFK75015
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguguguga

SEQ ID NO: 192081 - RNA, 1701 nt, Artificial Sequence; identical to SEQ ID NO: 185935
  derived and/or modified sequence opt5 from hemagglutinin__InfluenzaA__AFK75025

SEQ ID NO: 192082 - RNA, 1701 nt, Artificial Sequence; identical to SEQ ID NO: 185935
  derived and/or modified sequence opt5 from hemagglutinin__InfluenzaA__AFK75035

SEQ ID NO: 192083 - RNA, 1701 nt, Artificial Sequence; identical to SEQ ID NO: 185935
  derived and/or modified sequence opt5 from hemagglutinin__InfluenzaA__AFK75045

SEQ ID NO: 192084 - RNA, 1701 nt, Artificial Sequence; identical to SEQ ID NO: 185935
  derived and/or modified sequence opt5 from hemagglutinin__InfluenzaA__AFK75055

SEQ ID NO: 192085 - RNA, 1701 nt, Artificial Sequence; identical to SEQ ID NO: 185693
  derived and/or modified sequence opt5 from hemagglutinin__InfluenzaA__AFK75065

SEQ ID NO: 192086 - RNA, 1701 nt, Artificial Sequence; identical to SEQ ID NO: 185693
  derived and/or modified sequence opt5 from hemagglutinin__InfluenzaA__AFK75075

SEQ ID NO: 192087 - RNA, 1701 nt, Artificial Sequence; identical to SEQ ID NO: 186857
  derived and/or modified sequence opt5 from hemagglutinin__InfluenzaA__AFK75085

SEQ ID NO: 192088 - RNA, 1701 nt, Artificial Sequence; identical to SEQ ID NO: 186857
  derived and/or modified sequence opt5 from hemagglutinin__InfluenzaA__AFK75095

SEQ ID NO: 192089 - RNA, 1701 nt, Artificial Sequence; identical to SEQ ID NO: 185693
  derived and/or modified sequence opt5 from hemagglutinin__InfluenzaA__AFK75105

SEQ ID NO: 192090 - RNA, 1701 nt, Artificial Sequence; identical to SEQ ID NO: 185935
  derived and/or modified sequence opt5 from hemagglutinin__InfluenzaA__AFK77857

SEQ ID NO: 192091 - RNA, 1701 nt, Artificial Sequence; identical to SEQ ID NO: 185935
  derived and/or modified sequence opt5 from hemagglutinin__InfluenzaA__AFK77867

SEQ ID NO: 192092 - RNA, 1701 nt, Artificial Sequence; identical to SEQ ID NO: 191221
  derived and/or modified sequence opt5 from hemagglutinin__InfluenzaA__AFK77877

SEQ ID NO: 192093 - RNA, 1701 nt, Artificial Sequence; identical to SEQ ID NO: 185693
  derived and/or modified sequence opt5 from hemagglutinin__InfluenzaA__AFK77887

SEQ ID NO: 192094 - RNA, 1701 nt, Artificial Sequence
  derived and/or modified sequence opt5 from hemagglutinin__InfluenzaA__AFK77897
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccaucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaauccuuuuauaagaaccugauuuggcucgugaaaaagggcaauucuuacccuaaacuguccaagagcuauaucaacgauaaggggaaagaaguucuugugcuguggggcauucaccaccccuccaccucugccgaccaacagagccucuaccagaaugcugaugccuacgucuucgugggaacauccaaguauagcaaaaaguuuaaaccugagaucgcugugagaccgaagguccgggaccaggaggggcgcaugaacuacuauuggacccugguugaacccggagauaaaauuacguucgaggccacaggcaaccugcucgugccuagauacgcguuugccauggaacggaaugcugggucuggaaucauuaucuccgacacccccgugcaugauugcaacacaaccugucaaaccccuaagggcgccaucaauacaagccugcccuuccagaacauucacccgaucacgauuggcaagugcccuaaauaugucaagucuaccaaacuucgccuggcuacagggcucagaaaugugcccagcauccagucccggggacuguuuggcgccauugccggguucaucgagggaggcuggaccgggaugguugacggaugguacggcuaucaucaccagaacgaacaaggcucuggguacgcugcggaccuuaagagcacacagaaugccaucgauaaaauuaccaacaaggugaauagcgucaucgagaagaugaacacgcaguuuacagcugugggaaaagaguucaaucaccuggaaaagcgcauugagaaccucaauaaaaagguugacgauggcuuccuggacaucuggaccuacaacgccgaacugcucgugcugcuugagaaugaaagaacccuggauuaucaugacagcaacgucaaaaaccucuacgagaaggugcggucucagcugaagaauaacgccaaagagauugggaauggauguuuugaguucuaucacaagugcgauaacacauguauggaguccgucaaaaauggcaccuacgacuauccuaaguacagcgaagaggcuaaacuuaaccgcgaagagaucgauggggugaagcuggagucuacaagaaucuaucaaauucucgccaucuacuccacgguugcgagcucccuggugcuggucgugucucucggcgcuauuagcuuuuggaugugcuccaauggaucucugcagugccggaucuguauuuga

SEQ ID NO: 192095 - RNA, 1701 nt, Artificial Sequence; identical to SEQ ID NO: 190074
  derived and/or modified sequence opt5 from hemagglutinin__InfluenzaA__AFK78028

SEQ ID NO: 192096 - RNA, 1701 nt, Artificial Sequence; identical to SEQ ID NO: 185935
  derived and/or modified sequence opt5 from hemagglutinin__InfluenzaA__AFK78187

SEQ ID NO: 192097 - RNA, 1701 nt, Artificial Sequence; identical to SEQ ID NO: 189879
  derived and/or modified sequence opt5 from hemagglutinin__InfluenzaA__AFM45476

SEQ ID NO: 192098 - RNA, 1701 nt, Artificial Sequence
  derived and/or modified sequence opt5 from hemagglutinin__InfluenzaA__AFM45487
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagacagcgaaaugaauaagcuguucgagaaaaccaagaaacagcuucgggaaaacgcggaggauauggggaauggaugcuuuaagaucuaccacaagugugacaacgccugcauuggcucuaucagaaaugggaccuauaaccaugauguguaccgcgacgaggcucugaauaaccgguuccagauuaaaggcguugaacucaaguccggauacaaagacuggauccuguggauuagcuuugccaucuccugcuuccuucuguguguggcccuccugggcuuuaucaugugggcuugccaaaaggggaauauuagauguaacaucugcauuuga

SEQ ID NO: 192099 - RNA, 1701 nt, Artificial Sequence; identical to SEQ ID NO: 189879
  derived and/or modified sequence opt5 from hemagglutinin__InfluenzaA__AFM45489

SEQ ID NO: 192100 - RNA, 1701 nt, Artificial Sequence; identical to SEQ ID NO: 192098
  derived and/or modified sequence opt5 from hemagglutinin__InfluenzaA__AFM45494

SEQ ID NO: 192101 - RNA, 1701 nt, Artificial Sequence
  derived and/or modified sequence opt5 from hemagglutinin__InfluenzaA__AFM68954
augaaggccagacugcucgugcugcuuugcgcucuggccgcgaccgacgcugauacaaucuguauuggcuaccacgccaacaauagcacggacaccgucgauacacuccuggagaaaaacguuaccgugacacauuccgugaaucuucuggaagacucucacaacgggaagcucugcaaacugaagggaaucgcuccccugcagcucggcaaauguaauauugccggguggcugcuuggaaacccugagugcgauagccugcucccggcccgguccuggucuuauaucgucgaaacccccaauagcgagaacggcgcuuguuacccuggggacuucauugauuaugaggaacugaaggagcaacuuuccucugugagcucccuggaacgcuuugagaucuuccccaaggaaagcucuuggccuaaucauaacacacucaaaggaguuaccgccuccugcagccacggcggcaagucuuccuuuuacagaaaucugcuguggcucacgaaaaccgaggacagcuaucccaagcugucuaacuccuacgugaauaacaaagggaaggagguccuugugcuguggggaguucaucacccuagcuccucugaugaacagcagagccucuaucacaaugugaacgcguacgucuccguggugagcucuaacuacaauggccgguucacaccggagaucgccgcucgccccaaggucagaaaccagccugggcggaugaauuauuacuggacccugcuugaacccggagacacaauuaucuuugaggccaccggcaaccugauugcuccuugguaugccuucgcgcucucccgcggguuuggaagcggcaucauuacgucuaaugccagcaugcaugaauguaacacaaaaugccaaacaccccagggcgcuaucaauuccucucugccguuccagaacauucacccuguuaccaucggggagugucccaaguacgugagaagcaccaaacugcggauggugaccggacuccgcaauaucccuuccauucaguuuagaggccuguucggggccaucgcuggauuuauugagggcggguggacaggaaugaucgauggcugguauggcuaccaucaccaaaacgaacaggggagcggauaugccgccgaccagaagucuacgcagaaugcuauuaacggcaucaccaauaaagucaacuccgugaucgagaagaugaauacacaauucaccgcgguuagcaaagaauuuaacaaccuugagaagcggauggaaaaucugaacaagaaaguggaugacggguuccucgacauuuggacauacaaugccgagcugcuuguccugcucgagaacgaacgcacccuggauuuccacgaccugaaugugaagaaccucuacgagaaaguuaagucucagcugaaaaauaacgcuaaggaaaucggaaauggcugcuuugaguucuaucauaagugugauaacaaaugcauggaauccgugagaaaugggacguacgacuaucccaaguacagcgaggaguccaaacuuaaccgggaaaagauugauggcgucaaacuggagucuaugggaguguaucagauccucgccauuuacagcacagucgccuccucucuggugcugcuuguuagccucggcgcuaucuccuuuuggaugugcagcaaugggucucugcaaugucgcaucugcauuuga

SEQ ID NO: 192102 - RNA, 1701 nt, Artificial Sequence
  derived and/or modified sequence opt5 from hemagglutinin__InfluenzaA__AFM68965
augaagaccaucauugcccugagcuacaucuucugccaggugcucgcucaaaaccugcccggcaaugacaacuccacagccacgcuuugucuggggcaccaugcggucccuaauggaacccucguuaaaacaauuaccaacgaucagaucgaggugacaaaugcuaccgaacuggugcagucuagcuccacaggcagaauuugcgacucuccgcaccggauccuugaugggaagaacuguacccugaucgacgcccuccugggagauccccauugcgacggcuuucagaaugagaaaugggaucuguucgucgaacgcagcaaggccuuuuccaacuguuauccuuacgacgugcccgauuaugcuucucucagaagccugguugccuccagcgggacgcuugaguucauuaaugaaggauuuaacuggaccggcgugacacaaaauggcgggucuuacgcuugcaaacggggaccugacaacuccuucuuuagccgccugaauuggcucuauaagucugaguccaccuaccccguccugaacgugacaaugccuaauaacgauaacuucgacaagcuguauaucuggggcguucaccauccgagcaccgauaaagagcagacgaaucuguacgugcaggccucugggagagucacaguguccaccaagcggagccagcaaacaauuauccccaacgugggaucccgcccuugggucagaggccucucuagcgggauuuccaucuacuggaccauuguuaaacccggagacauccugcugaucaauagcaacggcaaucucauugcgccucggggcuauuuuaagauccgcaccgggaaaucuuccauuaugagaagcgacgcccccaucggaacauguucuagcgaaugcauuacgccgaacggcuccaucccuaaugauaagcccuuccagaacgugaauaagaucaccuacggggcuuguccuaaauaugugaagcagaacacacugaaacuugccaccggaaugcggaauguccccgagaagcagacacgcggcauuuuuggggcuaaagccggauucaucgaaaacggcugggagggcaugauugacgggugguacggauuuagacaccaaaauucugagggcaccgggcaggcggccgaucugaaaagcacgcaggcugccaucgaccaaauuaacggaaaacucaaucgggugaucgaaaagacaaacgagaaguuccaccagaucgaaaaagaguucuccgaaguugagggccgcauucaggaucuggagaaguauguggaagacaccaaaaucgaucuuuggagcuacaacgcugagcugcucgucgcccuggaaaaucagcauaccauugaccugacagauucugagaugaacaagcucuuugaaaagaccagacggcaacugagagagaaugccgaggacauggggaacggcugcuucaagaucuaucacaagugugauaaugcuugcauuggauccauccgcaacggcacauacgaccaugacguguaccgggaugaagcgcuuaauaacagauuucagauuaaagggguugagcuuaagagcggauauaaagacuggauccucuggaucucuuucgccauuuccugcuuucugcuuugugugguccugcucggcuucaucaugugggcuugccagaaggggaauauucgcuguaacaucugcauuuga

SEQ ID NO: 192103 - RNA, 1701 nt, Artificial Sequence
  derived and/or modified sequence opt5 from hemagglutinin__InfluenzaA__AFM68987
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuauuaaugaaggauucaacuggaccggcgugacacagucuggcggguccuacgcuugcaaacggggaagcgacaagucuuucuucucccgccugaauuggcucuaugagagcgagucuaaguacccuguccugaacgugaccaugcccaauaacggcaauuuugauaaacuuuauaucuggggaguucaccauccuuccacagacaaggaacaaaccaaccuguacgugagagccagcgggcgggucacgguguccacaaaacgcucucagcagaccgugauuccgaacaucggcagcagacccuggguccgggggcucuccagccgcauuucuaucuacuggacaauuguuaagccuggagauauccugcugaucaauuccaacggcaaucucauugcgcccagaggcuauuucaaaauccggaccgggaaguccucuauuaugcgcagcgacgccccuaucggaaccuguuccucugagugcauuacacccaacggcagcaucccgaaugacaagccuuuucagaacgugaauaaaaucacguacggggcuugucccaaguaugugaaacaaaacacccugaagcuggccacaggaaugagaaaugucccugaaaaacagacccggggcauuuucggggcuaucgccggauuuauugagaacggcugggagggcaugguggaugggugguacggauuccgccaccagaauagcgaaggcacagggcaggcggccgaccuuaagagcacccaagcugccaucgaucagauuaacggaaaacucaauagaguuaucgagaagacgaacgaaaaguuccaccagaucgagaaagaauuuucugagguggagggccggauucaagaccuggaaaaguaugucgaggauacaaaaaucgaccuuugguccuacaaugcugaacugcucguggcccuggagaaccagcauaccauugaucugaccgacagcgaaaugaacaagcucuuugagaaaacaagacgccagcugcgggagaaugccgaagauauggggaacggcugcuuuaagaucuaucacaagugugacaaugcuugcauuggaucuaucagaaacggcaccuacgaucaugacguuuaccgcgacgaggcgcuuaauaaccgguuccagauuaaagggguggaacugaaguccggauauaaagauuggauccucuggaucagcuuugccauuuccugcuuccugcuuugugucgugcugcucggcuuuaucaugugggcuugccaaaaggggaauauuagauguaacaucugcauuuga

SEQ ID NO: 192104 - RNA, 1701 nt, Artificial Sequence
  derived and/or modified sequence opt5 from hemagglutinin__InfluenzaA__AFM71720
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacgagagcgaguacaaguauccugcccugaacguggcgaugcccaauaacggaaaauucgauaagcuguacaucuggggcguucaucacccuauuaccgacagagaacaaacaaaucuguacgugcgggccucugggcgcgucaccguguccacgaaaagaagccagcagacagugaucccgaacauuggaucccggcccuggguccgcggccucucuagcagaaucuccauuuauuggaccaucguuaagccuggggauauccuguuuauuaacagcacaggaaaucugaucgcuccccggggcuacuucaaaauucgcaccggcaagucuuccaucaugagaagcgacgccccuauugggaccuguucuagcgagugcaucacacccaacggauccaucccgaaugacaagccuuuucagaacgugaauaaaauuacguauggcgcuuguccccgguacgugaagcaaaacacccucaaacuggccacagggaugcgcaaugucccugaaaagcagaccagaggaaucuucggcgcgauugccggguuuaucgagaacggaugggagggcaugguggauggcugguauggguuccggcaccaaaauucugaaggaacaggccaggcugccgaccuuaaaagcacccaggcugccauugaucagaucaacgggaagcugaauagacucaucgagaaaacgaacgaaaaguuccaucagauugagaaggaauuuuccgagguugagggacgcauccaagaccuggaaaaauacguggaggauacaaagauugaccuuuggagcuauaaugccgaacugcucgucgcucuggagaaccagcacaccaucgaucugaccgacucugaaaugaauaaacucuucgagaagacacggaaacagcugagagagaacgcggaagauaugggcaacgggugcuuuaagauuuaccauaagugugacaaugccugcaucggcuccauucgcaacggaaccuacgaucacgacguguaucgggacgaggcucuuaauaacagauuccagaucaaaggcguugaacuuaagagcggguacaaagauuggauccucuggauuucuuuugccaucuccugcuuccugcuuugugugguccugcucggauuuauuaugugggccugccaaaagggcaauauccgcuguaacauuugcaucuga

SEQ ID NO: 192105 - RNA, 1701 nt, Artificial Sequence
  derived and/or modified sequence opt5 from hemagglutinin__InfluenzaA__AFM71731
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuaugccugcaagcggggcagcgucaagucuuucuucucccgccucaacuggcugcacaaaagcgaguacaaguauccugcgcuuaaugugacaaugcccaacaaugggaaauuugauaagcuguacaucuggggaguucaucacccuucuaccgacagagaacaaacaaaccucuacgugcgggccuccggccgcgucaccgugagcacgaaaagaucccagcagacagugauuccgaauaucgggucucggcccuggguccgcggacugagcuccagaauuagcaucuauuggaccauuguuaagccuggcgauauccugcucaucaacucuacagggaaccugauugcuccccggggauacuucaagauccgcaccggcaaauccagcauuaugagaucugacgccccuaucggcaccuguagcuccgagugcauuacacccaaugggucuaucccgaacgacaagccuuuucagaaugugaaccggaucacguauggagcuuguccccgcuacgugaaacaaaauacccuuaagcuggccacaggcaugagaaacgucccugaaaaacagacccgggggauuuucggagcgaucgccggcuuuauugagaaugggugggagggaaugguggauggcugguauggcuucagacaccagaacagcgaagggacaggacaggcugccgaccucaaguccacccaagcugccaucgaucagauuaauggcaaacugaaccgccuuaucgagaagacgaaugaaaaguuucaucagaucgagaaagaauuuagcgagguugaggggcggauucaagaccuggaaaaguacguggaggauacaaaaaucgaccucuggucuuauaacgccgaacugcuggucgcucucgagaaucagcacaccauugaucugaccgacuccgaaaugaacaaacuuuucgagaagacaagaaagcagcugcgcgagaaugcggaagauaugggaaacggcugcuuuaagaucuaccauaaaugugacaacgccugcauugggagcauccggaauggcaccuacgaucacgacguguauagagacgaggcucucaacaaucgcuuccagauuaagggaguugaacugaaaucuggcuacaaggauuggauccuuuggaucuccuuugccauuagcugcuuccugcucugugugguccugcugggguuuaucaugugggccugccaaaaaggaaacauucgguguaauaucugcauuuga

SEQ ID NO: 192106 - RNA, 1701 nt, Artificial Sequence
  derived and/or modified sequence opt5 from hemagglutinin__InfluenzaA__AFM71754
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauauccugcccuuaaugucaccaugcccaacaacgagcaguucgacaagcuguacauuuggggcgugcaccauccugggacggauaaagaccagaucuuuccguaugcgcaagccucuggacgcauuacaguuuccaccaagagaagccagcagacagcuauccccaauauuggcucccggccucgcgugagaaacauccccucucggaucagcauuuacuggaccaucgucaaaccuggggauauucuccugaucaauuccaccggaaaccugauugcuccccgcggcuacuucaagaucagaagcgggaagucuuccaucaugcggagcgacgccccgauuggaaaauguaauucugagugcaucacaccuaacggcagcauucccaaugacaagccuuuucagaacgugaaucgcaucacguauggcgccugucccagauacgugaaacaaaacacccucaagcuggcgacagggaugcggaauguccccgaaaaacagacccgcggaauuuucggcgccaucgcuggguuuaucgagaacggaugggaaggcaugguugaugggugguauggauucagacaccaaaauuccgagggccggggccaggccgcugaccuuaagucuacacaggccgccauugaucagaucaacgggaaacugaauagacucauuggaaagaccaacgagaaguuccaccagaucgaaaaagaguuuagcgaaguggagggccgcauucaagaccuggaaaaguacguggaggauacgaaaaucgaccuuugguccuauaacgcugagcugcucgucgcgcuggaaaaucagcauacaauugaucugaccgacagcgagaugaacaaacucuucgaaaagaccaagaagcagcugcgggagaaugccgaagauauggggaacggaugcuuuaaaaucuaccacaagugugacaaugcuugcaucggcucuauuagaaacgggacauaugcccaugauguguaccgcgacgaggcccuuaauaaccgguuccagaucaaaggcguugagcugaaguccggauacaaagacuggauucucuggaucagcuuugcuauuucuugcuuccugcuuuguguggcccugcucggcuuuaucaugugggcgugccaaaaggggaauaucagauguaacauuugcaucuga

SEQ ID NO: 192107 - RNA, 1701 nt, Artificial Sequence
  derived and/or modified sequence opt5 from hemagglutinin__InfluenzaA__AFM71768
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacgauuuucaaaacaagaaaugggaccuguucgucgaaagaagcaaggccuauuccaauuguuacccuuaugaugugcccgacuacgcuucucuccggagccugguugccuccagcggcacgcuugaguuuaacaaugaaucuuucaacuggaccggggugacacagaauggaaccuccagcgcuugcauccgcagaucuaagaacuccuuuuucagccggcugaauuggcucacacaucugaacuuuaaauauccugcccuuaaugucaccaugcccaacaacgagcaguucgauaagcuguacauuuggggcgugcaccauccuggcacggacaaagaucagaucuuuccguaugcgcaagccucugggcgcauuacaguuuccaccaagagaagccagcagacagcuauccccaauauuggaucccggccucgcgugagaaacauccccucucggaucagcauuuacuggaccaucgucaaaccuggcgacauucuccugaucaauuccaccgggaaccugauugcuccccgcggauacuucaagaucagaagcggcaagucuuccaucaugcggagcgacgccccgauugggaaauguaauucugagugcaucacaccuaacggaagcauucccaaugauaagccuuuucagaacgugaaucgcaucacguauggcgccugucccagauacgugaaacaaaacacccucaagcuggcgacaggcaugcggaauguccccgaaaaacagacccgcgggauuuucggagccaucgcuggcuuuaucgagaacgggugggaaggaaugguugacggcugguauggguucagacaccaaaauuccgagggacggggccaggccgcugaucuuaagucuacacaggccgccauugaccagaucaacggcaaacugaauagacucauugggaagaccaacgagaaguuccaccagaucgaaaaagaguuuagcgaaguggagggacgcauucaagaucuggaaaaguacguggaggacacgaaaaucgaucuuugguccuauaacgcugagcugcucgucgcgcuggaaaaucagcauacaauugaccugaccgauagcgagaugaacaaacucuucgaaaagaccaagaagcagcugcgggagaaugccgaagacaugggcaacgggugcuuuaaaaucuaccacaagugugauaaugcuugcaucggaucuauuagaaacggcacauaugcccaugacguguaccgcgacgaggcccuuaauaaccgguuccagaucaaagggguugagcugaaguccggcuacaaagauuggauucucuggaucagcuuugcuauuucuugcuuccugcuuuguguggcccugcucggauuuaucaugugggcgugccaaaagggcaauaucagauguaacauuugcaucuga

SEQ ID NO: 192108 - RNA, 1701 nt, Artificial Sequence
  derived and/or modified sequence opt5 from hemagglutinin__InfluenzaA__AFM71791
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgagauuugcgacucuccgcaccagauccuugaugggaaaaauuguacgcugaucgacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacccuugaguuuaacaaugaaucuuucaacuggacaggagugacccagaauggcacauccagcgcuugcauucgcagaucuaagaacuccuuuuucagccggcugaauuggcucacccaucugaacuuuaaauauccugcccuuaaugucacgaugcccaacaacgagcaguucgacaagcuguacaucuggggcgugcaccauccugggacagauaaagaccagauuuuuccguaugcgcaagccucuggacgcaucaccguuuccacaaagagaagccagcagaccgugauucccaauaucggcucccggccucgcgucagaaacauucccucucggaucagcaucuacuggaccauugugaaaccuggggauauccuccugauuaauuccacaggaaaccugaucgcuccccgcggcuacuucaagauuagaagcgggaagucuuccaucaugcggagcgacgccccgaucggaaaauguaauucugagugcauuacgccuaacggcagcauccccaaugacaagccuuuucagaacgugaaucgcauuaccuauggcgcuugucccagauacgucaaacaaaacacacucaagcuggccaccgggaugcggaauguucccgaaaaacagacacgcggaaucuucggcgcgauugccggguuuaucgagaacggaugggaaggcaugguggaugggugguauggauucagacaccaaaauuccgagggccggggccaggcugccgaccuuaagucuacccaggcugccaucgaucagauuaacgggaaacugaauagacucaucggaaagacgaacgagaaguuccaccagauugaaaaagaguuuagcgaaguggagggccgcauccaagaccuggaaaaguacgucgaggauacaaaaauugaccuuugguccuauaacgccgagcugcucguggcucuggaaaaucagcauaccaucgagcugaccgauagcgaaaugaacaaacucuucgagaagacaaagaagcagcugcgggaaaaugcggaggacauggggaacggaugcuuuaaaauuuaccacaagugugauaaugccugcaucggcucuaucagaaacgggaccuaugaccaugauguuuaccgcgacgaggcucuuaauaaccgguuccagauuaaaggcguggaacugaaguccggauacaaagacuggauccucuggauuagcuuugccaucucuugcuuccugcuuugugucgcccugcucggcuuuauuaugugggcuugccaaaaggggaauaucagauguaacaucugcauuuga

SEQ ID NO: 192109 - RNA, 1701 nt, Artificial Sequence
  derived and/or modified sequence opt5 from hemagglutinin__InfluenzaA__AFM71824
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacaggacggcaccuccagcgcuugcauccgcagaucuaaaaauuccuuuuucagccggcugaacuggcucacacaucugaauuuuaaauauccugcccuuaacgucaccaugcccaauaacgagcaguucgauaagcuguacauuuggggcgugcaccauccugggacggacaaagaucagaucuuuccguaugcgcaagccucuggacgcauuacaguuuccaccaagagaagccagcagacagcuauccccaacauuggcucccggccucgcgugagaaauauccccucucggaucagcauuuacuggaccaucgucaaaccuggggacauucuccugaucaacuccaccggaaaucugauugcuccccgcggcuacuucaagaucagaagcgggaagucuuccaucaugcggagcgacgccccgauuggaaaauguaacucugagugcaucacaccuaauggcagcauucccaacgauaagccuuuucagaaugugaaccgcaucacguauggcgccugucccagauacgugaaacaaaauacccucaagcuggcgacagggaugcggaacguccccgaaaaacagacccgcggaauuuucggcgccaucgcuggguuuaucgagaauggaugggaaggcaugguugacgggugguauggauucagacaccagaacuccgagggccggggccaagccgcugaucuuaagucuacacaggccgccauugaccagaucaaugggaaacugaacagacucauuggaaagaccaaugagaaguuccaccagaucgaaaaagaguuuagcgaaguggagggccgcauucaagaucuggaaaaguacguggaggacacgaaaaucgaucuuugguccuauaacgcugagcugcucgucgcgcuggaaaaccagcauacaauugaccugaccgauagcgagaugaauaaacucuucgaaaagaccaagaagcagcugcgggagaacgccgaagacauggggaauggaugcuuuaagaucuaccacaagugugauaacgcuugcaucggcucuauuagaaaugggacauaugaccaugacguguaccgcgaugaggcccuuaacaaucgguuccagaucaaaggcguugagcugaaguccggauacaaagacuggauucucuggaucagcuuugccauuucuugcuuccugcuuuguguggcucugcucggcuuuaucaugugggccugccaaaaggggaacaucagauguaauauuugcaucuga

SEQ ID NO: 192110 - RNA, 1701 nt, Artificial Sequence
  derived and/or modified sequence opt5 from hemagglutinin__InfluenzaA__AFM71835
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccucuuguuacccuuaugacgugcccgauuacgcuagccuccggucccugguugccagcucugggacgcuugaauuuaauuccgagagcuucaacuggaccggagugacacagaauggcaccucuuccgcuugcauccgcagaagcuauaacucuuucuucucccggcugaauuggcucacacaucugaacuuuaaguacccugcccuuaaugucaccaugcccaacaaugagcaguucgacaagcuguauauuuggggcgugcaccauccugggacggauaaagaccagaucuuuccguacgcgcaagccagcggacgcauuacaguuuccaccaagagaucucagcaggcugugauccccaacauuggcagccggccucgcgucagaaacauccccucccggaucagcauuuacuggacaaucgugaaaccuggggauauucuccugaucaauucuaccggaaaccugauugcuccccgcggcuauuucaagaucagauccgggaaaagcucuaucaugcggagcgacgccccgauuggaaaguguaauuccgaaugcaucaccccuaacggcucuauucccaaugacaagccuuuucagaacgugaaucgcaucacauacggcgccugucccagauauauuaaacaaagcacgcucaagcuggcgaccgggaugcggaacguccccgagaaacagacacgcggaaucuucggcgccaucgcuggguuuauugaaaauggaugggagggcaugguugaugggugguacggauucagacaccagaacuccgagggccggggccaagccgcugaccuuaagagcacccaggccgccaucgaucagauuaaugggaaacugaacagacucaucggaaagacaaaugaaaaauuccaccagauugagaaggaauuuucugagguggaaggccgcauccaagaccuggagaaguauguggaggauaccaaaauugaccuuugguccuacaacgcugaacugcucgucgcgcuggagaaucagcauacgaucgaucugacagacagcgaaaugaacaagcucuuugagaaaaccaagaaacagcugcgggaaaacgccgaggauauggggaauggaugcuuuaagaucuaucacaagugugacaacgcuugcauuggcucuaucagaaaugggaccuacgaucaugacguguaccgcgacgaggcccuuaacaaucgguuccagauuaaaggcguugaacugaaguccggauauaaagauuggauccucuggauuagccuggccaucuccugcuuucuucuguguguggcucuccugggcuucaucaugugggccugccaaaaggggaacauuagauguaauaucugcauuuga

SEQ ID NO: 192111 - RNA, 1698 nt, Artificial Sequence
  derived and/or modified sequence opt5 from hemagglutinin__InfluenzaA__AFM71846
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuccuacgugaauaaaaaggggaaagagguucuggugcucuggggcauucaucacccgagcaacucuaaggaacagcagaaccuguaucagaaugagaacgcguacgucuccguggugacgagcaauuacaaccgcagauuuacccccgaaaucgccgagcggccuaagguccgcgaccaagcuggaagaaugaauuauuacuggacacuucugaaacccggggauaccauuaucuucgaggccaacggaaaucucauugcuccuauguaugccuuugcgcugucccggggcuucgggucuggaaucauuacaagcaacgccuccaugcacgaauguaauaccaagugccagacgccccuuggcgcuaucaacagcucucugccguaccagaauauccauccuguuacaauuggcgagugucccaaauaugugcgcuccgccaagcucagaauggugaccgggcugcggaacaucccuagcauucagucucgcggacuguuuggcgcuaucgccggguucauugaaggaggcuggacagggaugaucgacggaugguacggcuaucaccaucaaaaugagcagggcagcggguacgccgcugaucagaaauccacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuacaaugcugagcugcucguccugcuugaaaacgagcggacacuggacuuccacgauucuaaugugaagaaccucuaugaaaaaguuaagagccagcugaagaauaacgccaaagagauuggaaauggcugcuucgaguuuuaccacaagugugacaacgaaugcauggaguccgugcgcaaugggaccuaugauuaccccaaauauagcgaagagucuaagcugaacagagagaaagucgacggcgugaagcucgaauccaugggaaucuaccagauccuggccauuuauagcacagucgcuucuucccuugugcugcucguuagccugggcgccaucuccuucuggaugugcucuaaugggagccugcaaugucggauuugcaucuga

SEQ ID NO: 192112 - RNA, 1701 nt, Artificial Sequence; identical to SEQ ID NO: 185342
  derived and/or modified sequence opt5 from hemagglutinin__InfluenzaA__AFM71857

SEQ ID NO: 192113 - RNA, 1701 nt, Artificial Sequence
  derived and/or modified sequence opt5 from hemagglutinin__InfluenzaA__AFM71868
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcucuugcaagcgcagauccaacaauagcuuuuucucucggcugaacuggcucacacaucugaaguuuaaauauccugcucuuaaugucaccaugcccaacaacgagaaguucgacaaacuguacaucuggggagugcaccauccuguuacggauaaugaccagauucgccucuaugcccaggcguccgggagaaucacagugagcaccaagcggucccaacagacagucauuccgaacaucggcucucgccccagagugcgggauauuccuagccgcaucuccaucuacuggaccauugugaaacccggggacauccugcugauuaauagcaccggaaaccucaucgccccuagaggcuacuuuaagauucggucugggaaguccagcaucaugcgcucugacgcucccaucggaaaauguaauagcgagugcauuacaccgaacggcuccaucccuaaugauaagcccuuccagaacgucaauagaauuacguauggcgccuguccucgguacguuaaacagaacacccugaagcuggcuacagggaugcgcaaugugcccgaaaaacaaaccagaggaaucuuuggcgccauugcgggguucaucgagaacggaugggaaggcaugguggacgggugguauggauuucggcaccaaaauucugagggcaucggccaggccgcugaucuuaagagcacacaggccgcuauuaaccagaucaaugggaaacucaacagacugauuggaaagaccaacgagaaguuccaccagaucgaaaaagaguucuccgaagucgagggccgcauucaggaccuugaaaaguacguggaggauacgaaaaucgaccuguggagcuauaaugccgagcuccugguugcccuggaaaaccaacauacaauugaucucaccgacucugagaugaauaagcuguuugaacggaccaaaaagcagcuuagagagaacgcugaagauauggggaauggaugcuucaagaucuaccacaaaugugacaacgcgugcaucggcuccauucgcaaugggacauaugaucaugacguguaccgggacgaggcccugaacaauagauuucagaucaagggcgucgagcucaaaagcggauacaaggauuggauucuguggaucucuuucgcuauuuccugcuuucuucugugugugguucuccugggcuucaucaugugggccugccagaaagggaacauccgcuguaauauuugcaucuga

SEQ ID NO: 192114 - RNA, 1701 nt, Artificial Sequence; identical to SEQ ID NO: 190022
  derived and/or modified sequence opt5 from hemagglutinin__InfluenzaA__AFM71879

SEQ ID NO: 192115 - RNA, 1701 nt, Artificial Sequence
  derived and/or modified sequence opt5 from hemagglutinin__InfluenzaA__AFM71890
augaaggccagacugcucgugcugcuuugcgcucuggccgcgaccgacgcugauacaaucuguauuggcuaccacgccaacaauagcacggacaccgucgauacacuccuggagaaaaacguuaccgugacacauuccgugaaucuucuggaagacucucacaacgggaagcucugcaaacugaagggaaucgcuccccugcagcucggcaaauguaauauugccggguggcugcuuggaaacccugagugcgauagccugcucccggcccgguccuggucuuauaucgucgaaacccccaauagcgagaacggcgcuuguuacccuggggacuucauugauuaugaggaacugaaggagcaacuuuccucugugagcucccuggaacgcuuugagaucuuccccaaggaaagcucuuggccuaaucauaacacacucaaaggaguuaccgccuccugcagccacggcggcaagucuuccuuuuacagaaaucugcuguggcucacgaaaaccgaggacagcuaucccaagcugucuaacuccuacgugaauaacaaagggaaggagguccuugugcuguggggaguucaucacccuagcuccucugaugaacagcagagccucuaucacaaugugaacgcguacgucuccguggugagcucuaacuacaaucggcgcuucacaccggagaucgccgcuagacccaagguccggaaccagccuggccgcaugaauuauuacuggacccugcuugaacccggggacacaauuaucuuugaggccaccggaaaccugauugcuccuugguaugccuucgcgcucuccagaggcuuugggagcggaaucauuacgucuaaugccagcaugcaugaauguaacacaaaaugccaaacaccccagggcgcuaucaauuccucucugccguuccagaacauucacccuguuaccaucggcgagugucccaaguacgugcggagcaccaaacugcgcauggugaccgggcucagaaauaucccuuccauucaguuucggggacuguucggcgccaucgcuggguuuauugagggaggcuggacagggaugaucgauggaugguauggcuaccaucaccaaaacgaacagggcagcggguaugccgccgaccagaagucuacgcagaaugcuauuaacggaaucaccaauaaagucaacuccgugaucgagaagaugaauacacaauucaccgcgguuagcaaagaauuuaacaaccuugagaagcgcauggaaaaucugaacaagaaaguggaugacggcuuccucgacauuuggacauacaaugccgagcugcuuguccugcucgagaacgaaagaacccuggauuuccacgaccugaaugugaagaaccucuacgagaaaguuaagucucagcugaaaaauaacgcuaaggaaaucgggaauggaugcuuugaguucuaucauaagugugauaacaaaugcauggaauccgugcggaauggcacguacgacuaucccaaguacagcgaggaguccaaacuuaaccgcgaaaagauugauggggucaaacuggagucuaugggcguguaucagauccucgccauuuacagcacagucgccuccucucuggugcugcuuguuagccucggagcuaucuccuuuuggaugugcagcaauggcucucugcaauguagaaucugcauuuga

SEQ ID NO: 192116 - RNA, 1701 nt, Artificial Sequence; identical to SEQ ID NO: 192101
  derived and/or modified sequence opt5 from hemagglutinin__InfluenzaA__AFM71901

SEQ ID NO: 192117 - RNA, 1701 nt, Artificial Sequence
  derived and/or modified sequence opt5 from hemagglutinin__InfluenzaA__AFM71923
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucgacuguacccucauugaugcucugcugggcgacccccauugcgauucuuuucagaaugagacgugggaccucuucgucgaacggagcaaagccuuuuccaacuguuauccuuacgaugugcccgacuaugccucucugcgcagccuuguugcuuccagcgggacccuggaguucaucaaugaaggauuuacauggaccggcgugacacagaacggcgggucuaaugccugcaagagaggaccugauuccggcuucuuuagccggcucaacuggcuguacaaaucuggguccaccuaucccguccuuaaugugacgaugccuaacaaugacaacuucgauaagcuguacauuuggggaguucaccauccgagcacaaaccaagagcagaccucucucuaugugcaggcuuccggccgcgucacagugagcaccaagagaucccagcaaaccaucauucccaauaucgggucucggccuugggugcgcggacugagcuccagaauuagcaucuacuggacaaucgucaaacccggcgacauucugguuaucaacucuaauggcaaccucauugccccucggggguacuuuaagaugcgcacgggaaaauccagcaucaugagaucugacgcgcccauuggcaccuguaucagcgagugcaucacaccgaauggguccauuccuaacgauaagcccuuccagaaugugaacaaaaucaccuauggagccuguccuaaguacgugaagcagaauacacugaaacuugcuaccggcaugcggaacguccccgaaaagcagacgcgcgggcuguuuggagccauugcuggcuucaucgagaauggcugggaagggaugauugacggaugguauggcuuuagacaccaaaacucugaggggacaggacaggccgcggaucucaaaagcacccaggccgcuaucgaccaaaucaauggcaagcugaaccgggugauugagaaaaccaaugaaaaguuccaccagaucgagaaagaguucuccgaaguugaagggcgcauucaggaucuugagaaguacguggaggacacaaagaucgaucuguggagcuauaacgccgaacuccuggucgcucuggagaaccagcauaccauugaccucacagauucugaaaugaauaaacuguuugagaagacgagacggcaacuuagagaaaacgccgaggacaugggcaauggaugcuuccgcaucuaccacaaaugugauaacgccugcauuggcuccauccggaaugggaccuaugaccaugacguguacagagaugaggcucugaacaaucgcuuucagaucaagggaguugaacucaaaagcggcuacaaggacuggauucuguggaucucuuucgcgauuuccugcuuucuucugugugugguccuccugggguucaucaugugggccugccagaagggaaacauucgguguaauaucugcaucuga

SEQ ID NO: 192118 - RNA, 1701 nt, Artificial Sequence
  derived and/or modified sequence opt5 from hemagglutinin__InfluenzaA__AFM71934
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucgacuguacccucauugaugcucugcugggcgacccccauugcgauggguuucagaaugagacgugggaccucuucgucgaacggucuaaagccuuuagcaacuguuauccuuacgaugugcccgacuaugccucccugcgcucucuuguugcuagcuccggaacccuggaguucaucaaugaaggcuuuacauggaccggcgugacacagaacgggggaagcaaugccugcaagagaggcccugauucuggguucuuuucccggcucaacuggcuguacaaaagcggaucuaccuaucccguccuuaaugugacgaugccuaacaaugacaacuucgauaagcuguacauuuggggcguucaccauccguccacaaaccaagagcagaccagccucuaugugcaggcuucugggcgcgucacaguguccaccaagggaagccagcaaaccaucauucccaauaucggcuccagaccuugggugcggggccugucuagccgcauuuccaucuacuggacaaucgucaaacccggggacauucugguuaucaacagcaauggaaaccucauugccccuagaggcuacuuuaagaugcggacggggaaaucuuccaucaugcgcagcgacgcgcccauuggaaccuguaucucugagugcaucacaccgaauggcagcauuccuaacgauaagcccuuccagaaugugaacaaaaucaccuauggggccuguccuaaguacgugaagcagaauacacugaaacuugcuaccggaaugagaaacguccccgaaaagcagacgcggggccuguuuggcgccauugcuggguucaucgagaauggaugggaaggcaugauugacgggugguauggauuucgccaccaaaacuccgagggcacagggcaggccgcggaucucaaaucuacccaggccgcuaucgaccaaaucaauggcaagcugaacagagugauugagaaaaccaaugaaaaguuccaccagaucgagaaagaguucagcgaaguugaaggacggauucaggaucuugagaaguacguggaggacacaaagaucgaucugugguccuauaacgccgaacuccuggucgcucuggagaaccagcauaccauugaccucacagauagcgaaaugaauaaacuguuugagaagacgcgcagacaacuucgggaaaacgccgaggacaugggcaaugggugcuucagaaucuaccacaaaugugauaacgccugcauuggaucuauccgcaauggcaccuaugaccaugacguguaccgggaugaggcucugaacaauagauuucagaucaaggggguugaacucaaauccggauacaaggacuggauucuguggaucagcuucgcgauuucuugcuuucuucugugugugguccuccugggcuucaucaugugggccugccagaaggggaacauucgcuguaauaucugcaucuga

SEQ ID NO: 192119 - RNA, 1701 nt, Artificial Sequence
  derived and/or modified sequence opt5 from hemagglutinin__InfluenzaA__AFM71945
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucaauuguacccugauugacgcucuccugggcgauccccauugcgacggguuccagaacgagacgugggaucuguuugucgaacggucuaaagccuucagcaauuguuauccuuacgacgugcccgauuaugccucccuccgcucucugguugcuagcuccggaacccuugaguuuaucaacgaaggcuucacauggaccggcgugacacagaaugggggaagcaacgccugcaagagaggcccugacucuggguuuuucucccggcugaauuggcucuacaaaagcggaucugcuuaucccguccugaacgugaccaugccuaauaacgauaacuuugacaaacuuuacauuuggggcguucaccauccguccacggaucaagagcagacaaaucuguaugugcaggccagcgggcgcgucaccgugucuacaaagagaucccagcaaaccaucauucccaacaucggaagccggccuugggugcgcggccucuccucuagaauuagcaucuacuggaccaucgucaagcccggcgacauucugguuaucaauuccaacgggaaucugauugcgccucggggauacuucaagaugcgcacaggcaaaagcucuaucaugagauccgacgcccccauugggacguguaucagcgagugcaucaccccgaacggaucuauuccuaaugauaagcccuuucagaacgugaauaaaaucacauauggcgcuuguccuaaguacgugaagcagaacacccucaaacuggccacagggaugcggaauguccccgaaaagcagacccgcggaauuuucggcgcuaucgccggcuuuauugagaacgggugggaaggaaugaucgacggcugguauggguucagacaccaaaauagcgagggaacgggccaggcggccgaucuuaaauccacacaggcugccaucgaccaaauuaacgggaagcugaaucgggugaucgagaaaaccaacgaaaaguuccaccagauugagaaagaauuuucugagguugaaggccgcauccaggaucucgagaaguacguggaggacaccaagauugaucuguggagcuauaacgcugaacuucuggucgcccucgagaaucagcauacaaucgaccugaccgauuccgaaaugaacaaacuguucgagaagacaagacggcaacucagagaaaaugccgaggacaugggaaacggcugcuuuaaaauuuaccacaagugugauaaugcuugcaucgggagcauccgcaacggaacguaugaccaugacguguaccgggaugaggcgcugaauaacagauuccagauuaaaggcguugaacuuaagucuggguacaaggacuggauccuguggauuuccuuugccaucagcugcuuccuccugugugugguccuucugggauuuauuaugugggcuugccagaaaggcaauauccgcuguaacaucugcauuuga

SEQ ID NO: 192120 - RNA, 1701 nt, Artificial Sequence; identical to SEQ ID NO: 192119
  derived and/or modified sequence opt5 from hemagglutinin__InfluenzaA__AFM71956

SEQ ID NO: 192121 - RNA, 1704 nt, Artificial Sequence
  derived and/or modified sequence opt5 from hemagglutinin__InfluenzaA__AFM71978
augaagaccaucauugcccugagcuacaucuucugccucguguuugcucaggaccugcccggcaacgauaauaacuccacagccacgcuuugucuggggcaccaugcggucccuaauggaacccucguuaaaacaauuaccaacgaccaaaucgaggugacaaaugcuaccgaacuggugcagucuagcuccacaggcaagauuugcaacaauccgcacagaauccuugaugggaucaacuguacccugauugacgcccuccugggagauccccauugcgacggcuuccagaaugagaaaugggaucuguuugucgaacggucuaaggccuucagcaacuguuauccuuacgacgugcccgauuaugcuucccuccgcucucugguugccagcuccgggacgcuugaguuuaucaaugaaggauucaacuggaccggcgugacacagaauggcgggagcaacgcuugcaaaagaggaccugacucuggcuuuuucucccggcugaauuggcucuacaagagcgggucuaccuaucccguccaaaacgugacaaugccuaacaaugauaacuccgacaagcuguacauuuggggaguucaccauccgagcaccgauaaagagcagacgaaucuuuaugugcaggccucuggcaaggucacaguguccaccaaacgcagccagcaaacaaucauucccaacgugggguccagaccuuggguccggggacugucuagccgcaucuccauuuacuggaccaucguuaagcccggcgacauccucgugauuaauagcaacggcaaucugaucgcgccuagaggguacuuuaaaaugcggaccggaaagucuuccauuaugcgcagcgacgcccccaucggcacauguucuagcgagugcauuacgccgaacggguccaucccuaaugauaagcccuuccagaacgugaauaaaaucaccuauggagcuuguccuaaguacgucaaacagaacacacugaagcucgccaccggcaugagaaaugugcccgaaaaacagacacgggggauuuuuggagcuaucgccggcuucauugagaacggcugggaagggaugaucgacggaugguauggcuuucgccaccaaaauucugaggggaccggacaggcggccgaucuuaagagcacgcaggcugccauugaccaaaucaacggcaaacugaacagaguuaucgagaagacaaaugaaaaguuccaccagauugagaaagaguucuccgaaguggaagggcggauccaggaucuggagaaguacgucgaggacaccaaaauugaucucuggagcuauaacgcugaacugcuuguggcccuggagaaucagcauaccaucgaccucacagauucugaaaugaacaagcuguuugagaaaacccgcagacaacugcgggaaaaugccgaggacaugggcaacggaugcuucaagauuuaccacaagugugauaaugcuugcaucggcuccauuagaaacgggacauaugaccaugacguuuaccgcgaugaggcgcucaauaaccgguuucagaucaaaggaguggaacuuaagagcggcuacaaagacuggauccuguggauuucuuucgccaucuccugcuuucugcucugugucgugcugcuuggguucauuaugugggcuugccagaagggaaauaucagauguaacauuugcaucuga

SEQ ID NO: 192122 - RNA, 1701 nt, Artificial Sequence
  derived and/or modified sequence opt5 from hemagglutinin__InfluenzaA__AFM71989
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccuucuacggacaaagaucagaucuuucucuacacacaagcggccgggcgcauuaccguuuccacaaagagaagccagcaggcugugaucccgaauauuggaucccggccccgcgucagaaacaucccuucucgggugagcaucuauuggaccauugugaaacccggcgacauccugcugauuaauuccaccgggaaccucaucgccccucgcggauacuucaagauuagaagcggcaaaucuuccaucaugcggagcgaugcucccaucgggaaguguaauucugccugcauuacaccgaacggaagcaucccuaaugacaagcccuuucagaacgucaaucgcauuacguacggcgcguguccuagauauguuaaacaaaacacccugaaacuugccacaggcaugcggaaugugcccgaaaaacagacccgcgggaucuucggagcuauugccggcuuuaucgagaacgggugggaaggaaugguggacggcugguacggguucagacaccaaaauuccgagggacggggccaggcugccgaucugaagucuacacaggccgcuaucgaccagauuaacggcaaacucaacagacugaucgggaagaccaaugagaaauuccaucagauugaaaaggaguuuagcgaagucgagggacgcauccaagaucuugaaaaguauguggaggacacgaaaauugaucugugguccuacaacgcggagcuccugguugcccuggaaaaucagcacacaaucgaccucaccgauagcgagaugaacaagcuguucgaaaagaccaagaaacagcuucgggagaaugcugaagacaugggcaacgggugcuuuaagauuuaucauaagugugauaaugccugcaucggaucuaucagaaacggcacauacgaccacgauguguaucgcgacgaggcccugaauaaccgguuccagauuaaaggggucgagcucaaguccggcuacaaagacuggauccuguggauuagcuuugcuaucucuugcuuccuucuguguguggcccuccugggauuuauuaugugggcgugccaaaagggcaauaucagauguaacaucugcauuuga

SEQ ID NO: 192123 - RNA, 1701 nt, Artificial Sequence
  derived and/or modified sequence opt5 from hemagglutinin__InfluenzaA__AFM72010
augaagaccaucauugcccugagcuacaucuucugccaggugcucgcucaaaaccugcccggcaaugacaacuccacagccacgcuuugucuggggcaccaugcggucccuaauggaacccucguuaaaacaauuaccaacgaucagaucgaggugacaaaugcuaccgaacuggugcagucuagcuccacaggcagaauuugcgacucuccgcaccggauccuugaugggaagaacuguacccugaucgacgcccuccugggagauccccauugcgacggcuuucagaaugagaaaugggaucuguucgucgaacgcagcaaggccuuuuccaacuguuauccuuacgacgugcccgauuaugcuucucucagaagccugguugccuccagcgggacgcuugaguucauuaaugaaggauuuaacuggaccggcgugacacaaaauggcgggucuuacgcuugcaaacggggaccugacaaguccuucuuuagccgccugaacuggcucuaugagucugaguccaccuaccccguccugaaugugacaaugccuaacaaugauaacuucgacaagcuguauaucuggggcguucaccauccgagcaccgauaaagaacagacgaagcuguacgugcaggccucugggagagucacaguguccaccaaacggagccagcaaacaauuauccccaacgugggaucccgcccuugggucagaggccucucuagccggauuuccaucuacuggaccauuguuaagcccggggacauccugcugaucaauagcaacggaaaucucauugcgccucgcggcuauuuuaaaaucagaaccggcaagucuuccauuaugcggagcgacgcccccaucgggacauguucuagcgagugcauuacgccgaacggauccaucccuaaugauaagcccuuccagaacgugaauaaaaucaccuacggcgcuuguccuaaguaugugaaacagaacacacugaagcuggccaccgggaugcgcaauguccccgaaaaacagacaagaggaauuuuuggcgcuaucgccggguucauugagaacggaugggagggcaugaucgacggcugguacggguuucggcaccaaaauucugaaggaaccggccaggcggccgaucuuaagagcacgcaggcugccauugaccaaaucaacgggaaacucaaucgcgugaucgagaagacaaacgaaaaguuccaccagauugagaaagaguucuccgaaguugagggaagaauccaggaucuggaaaaguauguggaggacaccaaaauugaucuuuggagcuacaaugcugaacugcucgucgcccuggagaaccagcauaccaucgaccugacagauucugaaaugaacaagcucuuugagaaaacccggagacaacugcgcgagaaugccgaagacaugggcaacgggugcuucaagauuuaucacaagugugauaaugcuugcaucggcuccauucggaacggaacauacgaccaugacguguacagagaugaggcgcuuaauaaccgcuuucagaucaaaggcguugaacuuaagagcggguauaaagacuggauccucuggauuucuuucgccaucuccugcuuucugcuuugugugguccugcucggauucauuaugugggcuugccagaagggcaauauccgguguaacauuugcaucuga

SEQ ID NO: 192124 - RNA, 1701 nt, Artificial Sequence; identical to SEQ ID NO: 183939
  derived and/or modified sequence opt5 from hemagglutinin__InfluenzaA__AFM72021

SEQ ID NO: 192125 - RNA, 1701 nt, Artificial Sequence
  derived and/or modified sequence opt5 from hemagglutinin__InfluenzaA__AFM72032
augaagaccaucauugcccugagcuacauguucugccucguguuugcucagaaccugcccggcaaugacaacuccacagccacgcuuugucuggggcaccaugcggucccuaauggaacccucguuaaaacaaucaccaacgaucaaauugaggugacaaaugcuaccgaacuggugcagucuagcuccacaggcagaaucugcgacucuccgcaccggauucuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuaucaaugaaggauucaacuggaccggcgugacacagucuggcggguccuauaccugcaaacggggaagcaauaacagcuuuuucucccgccugaauuggcucuacgagagcgagucuaaguacccuguccugaacgugacaaugcccaauaacggcaaguuugacaaacuuuauauuugggggauccaccauccuuccaccgauaaggaacaaacgaaccuguacauuagagcuagcggacggguuacaguguccaccaaacgcucucagcagacagucaucccgaauauuggcagcagacccugggugcgggggcucuccagccgcaucucuauuuacuggaccaucgugaagccuggagacauccugcugauuaacuccaccggcaaucucaucgcccccagaggcuauuucaaaauucggacagggaagucuucuaucaugcgcagcgaugcgccuauuggaacguguuccucugagugcaucacccccaacggcagcaucccgaaugacaagccuuuucagaacgucaauaaaauuacauacggggccugucccagauauguuaagcaaaacacccugaaacuugcuacaggaaugcggaaugugccugaaaagcagacccgcggcaucuucggggccauugcuggauuuaucgagaacggcugggagggcaugguggacgggugguacggauucagacaccaaaauuccgaaggcacggggcaggccgcggaucugaaaagcacacaggccgcuauugaccagaucaacggaaagcucaaucgggucaucgagaaaaccaacgaaaaguuccaccagauugagaaggaauuuucugagguggagggcagaauccaagaucuggaaaaauauguugaggacaccaagauugaucuuugguccuacaaugccgaacugcucguggcucuggagaaccagcauacaaucgaccugaccgauagcgaaaugaacaaacucuucgagaagacacgcaaacagcugcgggagaaugccgaagacauggggaacggcugcuuuaagauuuaucacaagugugauaaugccugcaucggaucuauuagaaacggcacguacgaccaugaugucuaccgcgacgaggcucuuaauaaccgguuccagaucaaagggguggaacugaaguccggauauaaagacuggauccucuggauuagcuuugcgaucuccugcuuccugcuuuguguugugcugcucggcuuuauuaugugggccugccaaaaggggaauaucagauguaacauuugcaucuga

SEQ ID NO: 192126 - RNA, 1701 nt, Artificial Sequence
  derived and/or modified sequence opt5 from hemagglutinin__InfluenzaA__AFM72043
augaagaccaucauugcccugagcuacauguucugccucguguuugcucagaaccugcccggcaaugacaacuccacagccacgcuuugucuggggcaccaugcggucccuaauggaacccucguuaaaacaaucaccaacgaucaaauugaggugacaaaugcuaccgaacuggugcagucuagcuccacaggcagaaucugcgacucuccgcaccggauucuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuaucaaugaaggauucaacuggaccggcgugacacagucuggcggguccucuaccugcaaacggggaagcaauaacuccuuuuucagccgccugaauuggcucuacgagucugaguccaaguauccuguccugaacgugacaaugcccaauaacggcaaguuugacaaacuuuacauuugggggauccaccauccuagcaccgauaaggaacaaacgaaccuguauauuagagcuuccggacggguuacagugucuaccaaacgcagccagcagacagucaucccgaauauuggcuccagacccugggugcgggggcucagcucucgcaucuccauuuacuggaccaucgugaagccuggagacauccugcugauuaacagcaccggcaaucucaucgcccccagaggcuacuucaaaauucggacagggaagucuagcaucaugcgcuccgaugcgccuauuggaacguguucuagcgagugcaucacccccaacggcuccaucccgaaugacaagccuuuucagaacgucaauaaaauuacauauggggccugucccagauacguuaagcaaaacacccugaaacuugcuacaggaaugcggaaugugccugaaaagcagacccgcggcaucuucggggccauugcuggauuuaucgagaacggcugggagggcaugguggacgggugguauggauucagacaccagaauagcgaaggcacggggcaggccgcggaucugaaaucuacacaagccgcuauugaccagaucaacggaaagcucaaucgggucaucgagaaaaccaacgaaaaguuccaccagauugagaaggaauuuuccgagguggagggcagaauccaagaucuggaaaaauacguugaggacaccaagauugaucuuuggagcuauaaugccgaacugcucguggcucuggagaaccagcauacaaucgaccugaccgauucugaaaugaacaaacucuucgagaagacacgcaaacagcugcgggagaaugccgaagacauggggaacggcugcuuuaagauuuaccacaagugugauaaugccugcaucggauccauuagaaacggcacguaugaccaugaugucuaccgcgacgaggcucuuaauaaccgguuccagaucaaagggguggaacucaagagcggauacaaagacuggauccuguggauuuccuuugcgaucucuugcuuccugcuuuguguugugcugcucggcuuuauuaugugggccugccaaaaggggaauaucagauguaacauuugcaucuga

SEQ ID NO: 192127 - RNA, 1701 nt, Artificial Sequence
  derived and/or modified sequence opt5 from hemagglutinin__InfluenzaA__AFM72054
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaacauaauguuaccaagggagugacggcugccugcucucacaaaggcaaguccagcuuuuaucgcaaccuccuguggcuuaccgagaagaauggcucuuacccuaaccuguccaaaagcuaugucaauaacaaggaaaaagaggugcucguucuguggggagugcaucaccccuccaauaucgaagaccagaagacaauuuacagaaaagagaacgcguacgucucuguggugagcucccacuauaaccggcgcuucaccccugaaaucgccaagagaccgaaaguccggaaucaggaggggcgcauuaacuacuauuggacacugcucgagcccggcgauaccaucauuuuugaagcuaaugggaaccugaucgccccuugguacgcuuucgcccuuagcagaggauuuggcucugggauuaucacguccaaugcgagcauggacgagugugaugccaagugccagacaccccaaggagcuaucaacucuagccugccuuuccagaauguucaucccgugaccauuggcgaauguccgaaguaugugcgguccacaaaacuccgcauggucaccggccugagaaacaucccuucuauucagagccgggggcuuuuuggagccaucgcuggcuucauugaagggggauggaccggcaugaucgacgggugguacggauaucaccaucagaaugaacaaggcuccggcuacgccgccgaucaaaagagcacacagaacgcuaucaaugggauuacgaacaaaguuaauucuaucauugagaagaugaacacccaguuuacagcggugggaaaagaguucaauaagcuggaaaagcgcauggagaaccucaacaaaaagguggacgauggcuuccuggacaucuggaccuacaaugccgaacugcucguccugcuugagaacgaaagaacacuggacuuucacgauuccaaugugaaaaaccucuaugagaagguuaaaagccagcugaagaauaacgcuaaggagauugggaauggaugcuucgaauuuuaccacaaauguaacaaugagugcauggaaucugugaagaacggcaccuaugacuaccccaaauauuccgaggagagcaaacuuaaucgggagaagaucgauggggucaagcuggaguccaugggcguguaccagauccucgccauuuauucuacggucgccagcucccuggugcugcucguuucucugggagcuaucagcuucuggaugugcuccaacggcagccuucagugucgcauuugcaucuga

SEQ ID NO: 192128 - RNA, 1701 nt, Artificial Sequence; identical to SEQ ID NO: 192127
  derived and/or modified sequence opt5 from hemagglutinin__InfluenzaA__AFM72065

SEQ ID NO: 192129 - RNA, 1701 nt, Artificial Sequence
  derived and/or modified sequence opt5 from hemagglutinin__InfluenzaA__AFM72087
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuuauugaacgcagcaaagccuucuccaauuguuauccuuacgacguccccgauuaugcuucucucagaagccugguggccuccagcgggacgcuugaguuuaucaacgaaggauucaauuggaccggcguuacacagucuggcggguccuauaccugcaagcggggaagcgugaacagcuuuuucucccgccugaauuggcucuacgagagcgaguacaaguauccugcucugaacgucacaaugcccaauaacggcaaauuugacaagcuguacauuuggggagugcaccauccuucuaccgaaaaagagcaaacgaaucuguacguuagagccuccgggcgggugacagucagcaccaagcgcucccagcagacagugaucccgaacauuggcucuagccccugggugagagggcucuccagccggaucucuauuuauuggaccaucgucaaaccuggagauauccugcugauuaacuccaccggcaaucucaucgcgccccgcggcuacuucaagauuagaacagggaagucuucuaucaugcggagcgacgccccuauuggaacguguuccucugaaugcaucacccccaacggcagcaucccgaaugauaaaccuuuucagaacguuaauaagauuacauauggggcuuguccccgcuacgugaaacaaaacacccugaaacuugccacaggaaugagaaaugugccugagaagcagacccggggcaucuucggggcuauugccggauuuaucgagaacggcugggaaggcauggucgacgggugguauggauuccgccaccaaaauuccgagggcacggggcaggcggccgaccuuaagagcacacaggcugccauugaucagaucaacggaaaacucaauagacugaucgaaaagaccaacgagaaguuccaccagauugaaaaagaguuuucugagguggaaggccggauccaagaccuugagaaguacguugaagauaccaaaauugaccugugguccuauaaugcugagcuccugguggcccuggaaaaccaguacacaaucgaucucaccgacagcgagaugaauaagcuguucgagaaaacaagaaagcagcuucgcgaaaacgccgaggauauggggaacggcugcuuuaagauuuaccauaaaugugacaaugcuugcaucggaucuauucggaacggcacguaugaucacgacgucuacagagaugaagcgcugaauaaccgcuuccagaucaaggggguggagcucaaauccggauauaaggacuggauccuguggauuagcuuugccaucuccugcuuccuucuguguguugugcuccugggcuuuauuaugugggcuugccaaaaagggaauauccgguguaacauuugcaucuga

SEQ ID NO: 192130 - RNA, 1701 nt, Artificial Sequence
  derived and/or modified sequence opt5 from hemagglutinin__InfluenzaA__AFM72098
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcucuacaagagcgaguauaaauacccugcccugaacgugaccaugcccaauaacggaaaguucgauaaacuuuacaucuggggcguucaccauccugugacagacagagagcaaaccaaucuguauguccgggcgucugggcgcgugacgguguccacaaagagaagccagcagaccgucauuccgaacaucggaucccggcccuggguucgcggccucucuagcagaauuuccaucuacuggacaauugugaaaccuggggauauccugcugaucaacagcaccggaaaucucauugcuccccggggcuauuuuaagauccgcaccggcaagucuuccauuaugagaagcgacgccccuaucgggacauguucuagcgaaugcauuacgcccaacggauccaucccgaaugacaaaccuuuccagaacgugaauaagaucaccuacggcgccuguccccgguaugucaaacaaaacacacugaaacuugcuaccgggaugcgcaaugugccugagaaacagacaagaggaauuuuuggcgccaucgcgggguucauugaaaacggaugggagggcaugguugauggcugguacggguuucggcaccagaauagcgagggaaccggccaggccgcugaccugaagucuacgcaagccgcuaucgaucagauuaacgggaaacucaauagacugaucgaaaagacaaacgagaaguuccaccagaucgaaaaagaguucuccgaaguggagggacgcauucaagaccuugagaaguaugucgaagauaccaaaaucgaccuguggagcuacaaugccgagcuccugguggcccuggaaaaccagcauaccauugaucucacagacucugagaugaauaagcuguuugaaaagacccggaagcagcuuagagagaacgcugaggauaugggcaacgggugcuucaagaucuaccacaaaugugacaaugcgugcauuggcuccauccgcaacggaacauaugaucaugacguuuaccgggacgaagcccugaauaacagauuucagauuaagggcguggagcucaaaagcggguauaaggauuggauccuguggaucucuuucgcuauuuccugcuuucuucugugugucgugcuccugggauucaucaugugggccugccaaaaaggcaauauucgcuguaacaucugcauuuga

SEQ ID NO: 192131 - RNA, 1701 nt, Artificial Sequence
  derived and/or modified sequence opt5 from hemagglutinin__InfluenzaA__AFM72109
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacaagagcgaguacaaauauccugcccugaacgugaccaugcccaauaacggaaaguucgauaaacuuuacaucuggggcguucaucacccuauuacagacagagagcaaaccaaucuguacgugcgggcgucugggcgcgucacgguguccacaaagagaagccagcagaccgugaucccgaacauuggaucccggcccuggguccgcggccucucuagcagaaucuccauuuauuggacaaucguuaaaccuggggauauccugcugauuaacagcaccggaaaucucaucgcuccccggggcuacuuuaagauucgcaccggcaagucuuccaucaugagaagcgacgccccuauugggacauguucuagcgaaugcaucacgcccaacggauccaucccgaaugacaaaccuuuccagaacgugaauaagauuaccuauggcgccuguccccgguacgugaaacaaaacacacugaaacuugcuaccgggaugcgcaaugucccugagaaacagacaagaggaaucuuuggcgccauugcgggguucaucgaaaacggaugggagggcaugguggauggcugguauggguuucggcaccagaauagcgagggaaccggccaggccgcugaccugaagucuacgcaagccgcuauugaucagaucaacgggaaacucaauagacugaucgaaaagacaaacgagaaguuccaucagauugaaaaagaguucuccgaaguugagggacgcauccaagaccuugagaaguacguggaagauaccaaaauugaccuguggagcuauaaugccgagcuccuggucgcccuggaaaaccagcacaccaucgaucucacagacucugagaugaauaagcuguuugaaaagacccggagacagcuucgcgagaacgcugaggauaugggcaacgggugcuucaagauuuaccauaagugugacaaugcgugcaucggcuccauucggaacggaacauacgaucacgacguguauagagacgaagcccugaauaaccgcuuucagaucaaaggcguugagcucaagagcggguacaaagauuggauccuguggauuucuuucgcuaucuccugcuuucuucugugugugguccuccugggauucauuaugugggccugccaaaagggcaauauccgguguaacauuugcaucuga

SEQ ID NO: 192132 - RNA, 1701 nt, Artificial Sequence
  derived and/or modified sequence opt5 from hemagglutinin__InfluenzaA__AFM72120
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacgagagcgaguacaaguauccugcccugaacgugaccaugcccaauaacggaaaauucgauaaacuuuacaucuggggcguucaucacccuauuacagacagagaacaaaccaaucuguacgugcgggcgucugggcgcgucacgguguccacaaagagaagccagcagaccgugaucccgaacauuggauuucggcccuggguccgcggccucuccucuagaaucagcauuuauuggacaaucguuaagccuggggauauccugcugauuaacuccaccggaaaucucaucgcuccccggggcuacuucaaaauucgcaacggcaagagcucuaucaugagauccgacgccccuauugggaccuguagcucugagugcaucacacccaauggaagcaucccgaacgacaagccuuuucagaaugugaacaaaauuacguauggcgccuguccccgguacgugaagcaaaauacccugaaacuugcuacagggaugcgcaacgucccugaaaagcagaccagaggaaucuucggcgccauugcgggguuuaucgagaauggaugggagggcaugguggauggcugguauggguuccggcaccagaacuccgaaggaacaggccaggccgcugaccugaaaucuacccaagccgcuauugaucagaucaaugggaagcucaacagacugaucgagaaaacgaaugaaaaguuccaucagauugagaaggaauuuagcgagguugagggacgcauccaagaccuugaaaaauacguggaggauacaaagauugaccugugguccuauaacgccgaacuccuggucgcccuggagaaucagcacaccaucgaucucaccgacagcgaaaugaacaaacuguucgagaagacacggaaacagcuuagagagaacgcugaagauaugggcaaugggugcuuuaagauuuaccauaagugugacaacgcgugcaucggcucuauucgcaauggaaccuacgaucacgacguguaucgggacgaggcccugaacaauagauuccagaucaaaggcguugaacucaaguccggguacaaagauuggauccuguggauuagcuuugcuaucucuugcuuccuucugugugugguccuccugggauuuauuaugugggccugccaaaagggcaacauccgcuguaauauuugcaucuga

SEQ ID NO: 192133 - RNA, 1701 nt, Artificial Sequence
  derived and/or modified sequence opt5 from hemagglutinin__InfluenzaA__AFM72131
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaagacuguacccucaucgaugcccugcugggagacccccauugcgauggcuuucagaauaaggagugggaccucuucgucgaacgcagcaaagccuauuccaacuguuacccuuaugaugugcccgacuacgcuucucugagaagccuuguugccuccagcgggacgcuggaguuuauuaaugaagauuucaacuggaauggaguggcucagucuggcgaguccuaugccugcaagcggggcagcgucaaguccuuuuucucucgccucaacuggcugcacgagagcgaauacaaauauccugcgcuuaaugugaccaugcccaacaaugggaaguuugacaaacuguacaucuggggaguucaucacccuucuacagauagagagcaaaccaagcucuacgugcgggccuccggccgcgucacagugagcaccaaaagaucccagcagacggugauuccgaacaucgggucucggcccuggguccgcggacugagcuccagaauuagcaucuauuggacaauuguuaagccuggcgacauccugcucaucaauucuaccgggaaccugauugcuccccggggauacuucaagauccgcacaggcaaauccagcauuaugagaucugacgccccuaucggcaccuguagcuccgaaugcauuacccccaacgggucuaucccgaaugauaagccuuuucagaacgugaaucggaucacauauggagcuuguccccgcuacgugaaacaaaacacgcuuaagcuggccaccggcaugagaaaugucccugagaaacagacacgggggauuuucggagcgaucgccggcuuuauugagaacgggugggaaggaaugguggacggcugguauggcuucagacaccagaauagcgaggggaccggacaggcugccgaucucaaguccacacaagcugccaucgaccagauuaacggcaaacugaaucgccuuaucgaaaagaccaacgagaaguuucaucagaucgaaaaagaguucagcgagguugaagggcggauucaagaucuggagaaguacguggaagacacgaaaaucgaucucuggucuuauaaugccgagcugcuggucgcucucgaaaaccagcacacaauugaccugaccgauuccgagaugaauaaacuuuucgagaagaccagaaagcagcugcgcgaaaacgcggaggacaugggaaauggcugcuuuaagaucuaccauaaaugugauaacgccugcauugggagcauccggaacggcacauacgaccacgacguguauagagaugaagcucucaauaaccgcuuccagauuaagggaguugagcugaaaucuggcuacaaggacuggauccuuuggaucuccuuugccauuagcugcuuccugcucugugugguccugcugggguuuaucaugugggccugccaaaaaggaaauauucgguguaacaucugcauuuga

SEQ ID NO: 192134 - RNA, 1701 nt, Artificial Sequence
  derived and/or modified sequence opt5 from hemagglutinin__InfluenzaA__AFM72142
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacaaggagugggaucuguucgucgaacgcuccaaagccuauucuaauuguuacccuuaugacgugcccgauuacgcuagccucagaucccugguugccagcucugggacgcuugaguuuauuaacgaagacuucaauuggaccggaguggcucaggauggcggcuccuaugccugcaagcgggggagcgucaacucuuucuucucccgccugaauuggcuccacaagcuggaguacaaauauccugcgcuuaacgugacaaugcccaauaacggaaaguuugacaaacuguacaucuggggcguucaucacccuagcaccgauagagaccaaacaucucucuacgugcgggccuccgggcgcgucaccgugagcacgaagagaucccagcagacagugauuccgaauaucggaucucggcccuggguccgcggccagagcuccagaauuagcaucuauuggaccauuguuaaaccuggggacauccugcugaucaacucuacaggaaaccucauugcuccccggggcuacuucaagauccgcaauggcaaguccagcauuaugagaucugaugccccuaucgggaacuguagcuccgagugcauuacccccaauggaucuaucccgaacgacaaaccuuuucaaaaugugaaccggaucaccuauggcgcuuguccccgcuacgugaagcagaauacacugaaacuugccacggggaugagaaacgucccugaaaagcagacccggggaauuuucggcgcgaucgccggguuuauugagaauggaugggaaggcaugguggauggcugguauggguucagacaccagaacagcgagggaacaggccaagcugccgaccugaaauccacccaggcugccaucgaucagauuaaugggaagcucaaccgccugaucgagaaaacaaaugaaaaguuucaucaaaucgagaaggaauuuagcgagguugaaggacggauucaggaccuugagaaauacguggaggauaccaagaucgaccuguggucuuauaacgccgaacuccuggucgcucuggagaaucagcacacgauugaucucacagacuccgaaaugaacaaacuguucgagagaacccgcaagcagcuucgggaaaacgcggaggauaugggcaaugggugcuuuaaaaucuaccauaagugugacaacgccugcauuggcagcaucagaaauggaaccuacgaccacgauguguaucgcgacgaggcucugaacaaucgguuccaaauuaagggcguugaacucaaaucuggguacaaggauuggauccuguggaucuccuuugccauuagcugcuuccuucugugugugguccuccugggauuuaucaugugggccugccagaaaggcaacauuagauguaauaucugcauuuga

SEQ ID NO: 192135 - RNA, 1701 nt, Artificial Sequence
  derived and/or modified sequence opt5 from hemagglutinin__InfluenzaA__AFM72153
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgggucuccgcaccggauccuggacgggaaaaauuguacccucaucgaugcccugcugggcgacccccauugcgauggguuucagaacaaggagugggaccucuucgucgaacgcagcaaagccuauuccaauuguuacccuuaugaugugcccgacuacgcuucucugagaagccuuguugccuccagcggaacgcuggaguuuauuaacgaagauuucaauuggaccggcguggcucaggacggcgggucuuaugccugcaagcggggauccgucaacagcuuuuucucucgccucaauuggcugcacaagcuggaguacaaauauccugcgcugaacgugacaaugcccaauaacggcaaguuugauaaacucuacaucuggggaguucaucacccuuccaccgacagcgaucaaacaucucuguacgugagagccuccggacgggucaccgugagcacgaagcgcucccagcagacagugaccccgaauauuggcucuagacccuggguccgggggcagagcucccgcaucggaauuuauuggacaaucguuaaaccuggcgacauucugcucaucaacagcaccggcaaccugaucgcucccagaggguacuucaagauucggaauggaaagucuuccaucaugcgcagcgacgccccuauuggcaacuguucuagcgagugcaucacccccaauggguccauuccgaacgauaaaccuuuucaaaaugugaacagaaucacauauggagcuuguccccgguacgugaagcagaauacgcuuaaacuggccaccggcaugcgcaacgucccugaaaagcagacaagagggaucuucggagcgauugccggcuuuaucgagaauggcugggaagggaugguggacggaugguauggcuuccggcaccagaacucugaggggaccggacaagcugccgaucucaaaagcacacaggcugccauugaccagaucaauggcaagcugaacagacuuauugagaaaaccaaugaaaaguuucaucaaaucgagaaggaguucuccgaaguugaagggcgcauccaggaucuggagaaauacguggaggacacgaagauugaucucuggagcuauaacgccgaacugcuggucgcucucgagaaucagcacacaaucgaccugaccgauucugaaaugaacaaacuuuucgagaagacccggaaacagcugagagaaaacgcggaggacaugggcaauggaugcuuuaagauuuaccauaagugugauaacgccugcaucggcuccauucgcaaugggacauacgaccacgacguguaucgggaugaggcucucaacaauagauuccaaaucaaaggaguugaacuuaagagcggcuacaaagacuggauucuuuggaucucuuuugccaucuccugcuuccugcucugugugguccugcugggguuuauuaugugggccugccagaagggaaacauccgcuguaauauuugcaucuga

SEQ ID NO: 192136 - RNA, 1701 nt, Artificial Sequence
  derived and/or modified sequence opt5 from hemagglutinin__InfluenzaA__AFM72164
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuauuaacgaaaauuucaacuggaccggaguggcucaggacggcaagagcuaugccugcaagcggggcucugucaauuccuuuuucagccgccucaacuggcugcacaaacuugaguacaaguaucccgcgcugaaugugacaaugccuaacaaugggaaauuugauaagcucuacaucuggggaguucaucacccgucuaccgacuccgaucaaacaagccuguacgugagagccucuggccgggucaccguguccacgaaacgcagccagcagacagugauucccgacaucggguauagaccuuggguccggggacaguccucucgcauuagcauccacuggaccauuguuaagcccggcgacauccugcucaucaacuccacagggaaccugauugcuccuagaggauacuucaagauccggaauggcaaaagcucuauuaugcgcuccgaugcccccaucggcaacuguagcucugagugcauuaccccgaaugggagcaucccuaacgacaagcccuuucaaaaugugaacagaaucaccuauggagcuuguccucgguacgugaaacagaauacacuuaagcuggccacgggcaugcgcaacguccccgaaaaacagaccagagggauuuucggagcgaucgccggcuuuauugagaaugggugggaaggaaugguggauggcugguauggcuuccggcaucagaacuccgaggggacaggacaagcugccgaccucaagucuacccaggcugccaucgaucagauuaauggcaaacugaacagacuuguugagaagacaaaugaaaaguuucaccaaaucgagaaagaguucagcgaaguggaagggcgcauccaggaccuggagaaguacgucgaggauaccaaaauugaccucugguccuauaacgccgaacugcugguggcucucgagaaucagcauacgaucgaucugacagacagcgaaaugaacaaacuuuucgagcggaccagaaagcagcugcgcgaaaacgcggaggauaugggaaauggcugcuuuaagauuuaccacaagugugacaacgccugcaucgggucuauucggaauggcaccuacgaccacgauguuuauagagacgaggcucucaacaaucgcuuccaaaucaaaggaguggaacugaaguccggcuacaaagauuggauucuuuggaucagcuuugccaucucuugcuuccugcucugugucgugcugcugggguuuauuaugugggccugccagaagggaaacauccgguguaauauuugcaucuga

SEQ ID NO: 192137 - RNA, 1701 nt, Artificial Sequence
  derived and/or modified sequence opt5 from hemagglutinin__InfluenzaA__AFM72175
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuauuaacgaaaauuucaacuggaccggaguggcucaggacggcaagagcuaugccugcaagcggggcucugucaauuccuuuuucagccgccucaacuggcugcacaaacuugaguacaaguaucccgcgcugaaugugacaaugccuaacaaugggaaauuugauaagcucuacaucuggggaguucaucacccgucuaccgacuccgaucaaacaaaccuguacgugagagccagcggccgggucaccgugucuacgaaacgcucccagcagacagugauucccgacaucggguauagaccuuggguccggggacagagcucccgcauuucuauccacuggaccauuguuaagcccggcgacauccugcucaucaacagcacagggaaucugauugcuccuagaggauacuucaagauccggaacggcaaauccagcauuaugcgcucugaugcccccaucggcaauuguuccagcgagugcauuaccccgaacgggucuaucccuaaugacaagcccuuucaaaacgugaauagaaucaccuauggagcuuguccucgguacgugaaacagaacacacuuaagcuggccacgggcaugcgcaauguccccgaaaaacagaccagagggauuuucggagcgaucgccggcuuuauugagaacgggugggaaggaaugguggauggcugguauggcuuccggcaucagaauagcgaggggacaggacaagcugccgaccucaaguccacccaggcugccaucgaucagauuaacggcaaacugaauagacuuguugagaagacaaacgaaaaguuucaccaaaucgagaaagaguucucugaaguggaagggcgcauccaggaccuggagaaguacgucgaggauaccaaaauugaccucuggagcuauaaugccgaacugcugguggcucucgagaaccagcauacgaucgaucugacagacuccgaaaugaacaaacuuuucgagcggaccagaaagcagcugcgcgaaaaugcggaggauaugggaaacggcugcuuuaagauuuaccacaagugugacaaugccugcaucgggagcauucggaacggcaccuacgaccacgauguuuauagagacgaggcucucaauaaccgcuuccaaaucaaaggaguggaacugaagucuggcuacaaagauuggauucuuuggaucuccuuugccaucagcugcuuccugcucugugucgugcugcugggguuuauuaugugggccugccagaagggaaauauccgguguaacauuugcaucuga

SEQ ID NO: 192138 - RNA, 1701 nt, Artificial Sequence
  derived and/or modified sequence opt5 from hemagglutinin__InfluenzaA__AFM72197
augaagaccaucauugcccugagcuacauccucugcaugguguucgcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaacaaugaaucuuucaacuggaccggaguggcucagaauggcacauccuaugccugcaagcggcgcagcgucaaguccuuuuucucuagacugaacuggcuccacaaacuggaguacaaguauccugcgcuuaaugugaccaugcccaacaaugacaaauuugauaagcuguacauuuggggcguucaucacccuaucacagacagcgagcaaaccucucucuacgugcaggccuccgggcgggucacggugagcacaaaacgcucccagcagaccgugauuccgaacaucggauauagacccuggguccggggcguuucuagccgcauuuccaucuacuggacaauugugaagccuggggauauccugcugaucaacagcaccggaaaucucauugcucccagaggcuauuucaagauccggucugggaaauccagcauuaugcgcucugacgccccuaucggaaacuguaauagcgaaugcauuacccccaacggcuccaucccgaaugacaagccuuuucaaaacgugaauagaaucacauacggcgcuuguccccgguaugucaaacagaacacgcugaagcuggccaccgggaugcgcaaugugccugagaaacagacaagaggaauuuucggcgcgaucgccggguuuauugaaaacggaugggagggcaugguugaugggugguacggauuccggcaccaaaauucugagggcaccggccaggcugccgaccuuaagagcacacaggcugccaucaaccagauuaaugggaaacucaacagacugaucgaaaagaccaaugagaaguuucaucaaaucgaaaaagaguucuccgaaguggagggacgcauucaggaucuugagaaguaugucgaagacacgaaaaucgaucuguggagcuacaacgccgagcuccugguggcucuggaaaaccagcacacaauugaccucaccgauucugagaugaauaagcuguucgaacggaccagaaaacagcuucgcgagaacgcggaggacaugggcaaugggugcuuuaagaucuaccauaagugugauaacgccugcauuggauccauccggaauggcacauaugaccacgauguuuacagagacgaagcucugaacaaucgcuuccaaauuaaagggguggagcucaagagcggcuauaaagacuggauccuguggaucucuuuugccauuuccugcuuccuucugugugucgugcuccugggauuuaucaugugggccugccagaagggcaacauuaaauguaauaucugcauuuga

SEQ ID NO: 192139 - RNA, 1701 nt, Artificial Sequence
  derived and/or modified sequence opt5 from hemagglutinin__InfluenzaA__AFM72208
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuauuaacuccuuuuucagccgccucaauuggcugcaccagcuuaaguauagauacccugcgcugaacgucaccaugcccaauaacgacaaguuugauaaacucuauaucuggggcgugcaucacccuucuacagacuccgaucagaccagccuguacacgcaggccuccgggcggguuacagugucuaccaagcgcagccaacagacagucauuccgaacaucggauccagacccugggugcggggcauuagcucucgcaucuccauuuacuggaccaucgugaaaccuggggacauccugcucauuaauagcaccggaaaccugaucgcucccagaggcuauuucaagauucggucugggaaaagcuccaucaugcgcucugacgccccuauuggaaaguguaauagcgagugcaucacacccaacggcuccaucccgaaugauaagccuuuucagaacgucaauagaauuacguacggcgcuuguccccgguauguuaaacagaacacccuuaagcuggccacagggaugcgcaaugugccugaaaaacaaaccagaggaaucuucggcgcgauugccggguuuaucgagaacggaugggaaggcaugauggacgggugguacggauuccggcaccagaauagcgagggcacaggccaggcugccgaucucaagucuacccaagcugccauuaaccagaucaaugggaaacugaacagacuuaucgagaagacgaaugaaaaauuucaucagauugagaaggaguucuccgaaguggaaggacgcauccaggaccuggagaaguaugucgaggauacaaaaauugaccucuggagcuacaacgccgaacugcugguggcucucgagaaccaacacaccaucgaucugaccgacucugaaaugaauaagcuguucgagcggacaagaaaacagcugcgcgaaaacgcggaggauaugggcaaugggugcuuuaagauuuaucauaaaugugacaacgccugcaucggauccauucggaauggcaccuacgaucacgacguuuacagagacgaggcucucaacaaucgcuuccagaucaaggggguggaacuuaagagcggcuauaaagauuggauccuuuggauuuccuuugccaucucuugcuuccugcucugugucgugcugcugggauuuauuaugugggccugccagaagggcaacauccgguguaauauuugcaucuga

SEQ ID NO: 192140 - RNA, 1701 nt, Artificial Sequence
  derived and/or modified sequence opt5 from hemagglutinin__InfluenzaA__AFM72219
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuauuaacuccuuuuucagccgccucaauuggcugcaccagcuuaaguauagauacccugcgcugaacgucaccaugcccaauaacgacaaguuugauaaacucuauaucuggggcgugcaucacccuucuacagacuccgaucagaccagccuguacacgcaggccuccgggcggguuacagugucuaccaagcgcagccaacagacagucauuccgaacaucggauccagacccugggugcggggcauuagcucucgcaucuccauuuacuggaccaucgugaaaccuggggacauccugcucauuaagagcaccggaaaucugaucgcucccagaggcuauuucaaaauucggucuggaaagagcuccaucaugcgcucugacgccccuauugggaaguguaacagcgagugcaucacacccaauggcuccaucccgaacgauaaaccuuuucagaaugucaacagaauuacguacggcgcuuguccccgguauguuaagcagaauacccuuaaacuggccacagggaugcgcaacgugccugaaaagcaaaccagaggaaucuucggcgcgauugccggguuuaucgagaauggaugggaaggcaugauggacgggugguacggauuccggcaccagaacagcgagggcacaggccaggcugccgaucucaaaucuacccaagcugccauuaaucagaucaacgggaagcugaauagacuuaucgagaaaacgaacgaaaaguuucaucagauugagaaggaguucuccgaaguggaaggacgcauccaggaccuggagaaauaugucgaggauacaaagauugaccucuggagcuacaaugccgaacugcugguggcucucgagaaccaacacaccaucgaucugaccgacucugaaaugaacaaacuuuucgagcggacaagaaagcagcugcgcgaaaaugcggaggauaugggcaacgggugcuuuaaaauuuaucauaagugugacaaugccugcaucggauccauucggaacggcaccuacgaucacgacguuuacagagacgaggcucucaauaaccgcuuccagaucaaggggguggaacugaaaagcggcuauaaggauuggauccuuuggauuuccuuugccaucucuugcuuccugcucugugucgugcugcugggauuuauuaugugggccugccagaaaggcaauauccgguguaacauuugcaucuga

SEQ ID NO: 192141 - RNA, 1698 nt, Artificial Sequence
  derived and/or modified sequence opt5 from hemagglutinin__InfluenzaA__AFM72230
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaaaagucuuggagcuacauuguugagaccccgaaucccgaaaacggcacguguuauccuggguacuuugccgacuaugaggagcugagagaacaacucuccucugugagcuccuucgagcgguuugaaaucuuccccaaggagagcucuuggccuaaucauaccgucacaggaguguccgcuagcugcucucacaacggcaaauccagcuuuuaccgcaaucugcuuuggcugaccggcaagaacgggcucuaucccaaucugucuaaauccuacguuaacaauaaggagaaagaagugcugguccucuggggagugcaucacccuccgaacaucggcaaccagagagcccuguaccacacagagaaugcuuaugugagcgucguuuccucucauuacagccggcgcuucacccccgaaauugccaagagaccuaaggugcgggaucaggaggggcgcaucaacuauuacuggacgcuucuggaacccggagacacaauuaucuuugaggcgaauggcaaccucauugccccuugguaugcuuucgcccuguccagaggguuuggaagcggcaucauuaccucuaaugcucccauggaugagugugacgccaaaugccagacaccgcaaggcgcgaucaacuccagccuuccuuuccagaaugugcaccccgucaccaucggggaauguccuaaguacgugcggucugccaaacugcgcaugguuaccggacucagaaacauucccagcauccagucccggggccuguuuggggcuauugccggauucaucgagggcggguggacaggaaugguggauggcugguauggcuaccaucaccagaaugaacaagggucuggauacgcugccgaccaaaagagcacgcagaacgccauuaauggcaucaccaacaaagucaauuccgugaucgagaagaugaacacacaguuuaccgcuguugggaaagaguucaauaagcuggaacgcagaauggagaaccucaacaagaaaguggaugacggauuccuggauauuuggacauauaaugcggaacuucugguccuccuggagaacgaacggacccuugacuuucacgacagcaaugugaagaaccuguacgagaaagucaagucucagcucaaaaauaacgccaaggaaaucggcaaugggugcuucgaguuuuaucauaaguguaacaaugagugcauggaauccgugaaaaacggcacguacgauuaucccaaguacagcgaggaaucuaaacugaaucgcgagaagauugacggaguuaaacuggaguccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 192142 - RNA, 1701 nt, Artificial Sequence
  derived and/or modified sequence opt5 from hemagglutinin__InfluenzaA__AFM72246
augaagaccaucauugcccugagcuacauccucugccugguguucgcucagaaacuucccggcaacgacaauuccacagccacgcugugucucgggcaccaugcggucucuaacggaacccugguuaagacaauuaccaaugaucaaaucgaggugacaaacgcuaccgaacuugugcagagcuccucuacaggcagaauuugcgacagcccucaccagauccuggauggggagaauuguacccucaucgacgcccugcugggagauccgcauugcgacggcuuucagaacaaagaaugggaucucuucgucgagcgguccaaggccuauucuaauuguuaccccuaugacgugccugauuacgcuagccugcgcucccuuguugccagcucugggacgcuggaauuuaacaaugaguccuucaacuggaccggaguggcucaaaauggcacaagcucugccugcaaaagacgguccaacaagagcuuuuucucucgccucaauuggcugcaccagcuuaaguauaaauaccccgcgcugaacgucaccaugccuaauaacgagaaguuugacaaacucuauauuuggggcgugcaucaccccuccacagauagcgaccagaucuccauuuacgcccaggcuucugggagaguuaccgugagcacgaagcggucccaacagacagucaucccuaacauuggaagcucuccgugggugcgcggcguguccagcagaaucucuauuuacuggaccaucgucaaacccggggauauccugcugauuaauagcacaggaaaccucaucgccccucggggcuauuucaagauucgcuccgggaagucuagcaucaugagauccgacgcucccauuggaaaauguaauagcgaaugcaucaccccuaacggcucuauccccaaugacaagccguuucagaacguuaaucggauuaccuacggcgccuguccucgcuaugugaaacagaacacacugaagcuggcgacggggaugagaaaugugcccgagaaacaaacccggggaaucuucggcgccauugcuggguuuaucgaaaacggaugggagggcauggucgaugggugguacggauuccgccaccaaaauuccgagggcacaggccaggccgcugaccuuaagagcacccaggccgccauuaaccagaucaaugggaaacucaacagacugaucgaaaagacaaaugagaaguuucaucagauugaaaaagaguucucugaaguggagggacggauccaggaucuugagaaguauguugaagacaccaaaauugaucugugguccuacaacgcugagcuccugguggcgcuggaaaaccaacacacgaucgaccucacagauagcgagaugaauaagcuguucgaaagaaccaaaaagcagcuucgcgagaacgccgaggacaugggcaaugggugcuuuaagauuuaucauaaaugugauaacgcuugcaucggauccauucggaauggcaccuacgaccacgaugucuacagagacgaagcccugaacaaucgcuuccagaucaaggggguggagcucaaaucuggcuauaaggacuggauccuguggauuagcuuugccaucuccugcuuccuucuguguguugugcuccugggauuuauuaugugggcuugccagaaaggcaacauccgguguaauauuugcaucuga

SEQ ID NO: 192143 - RNA, 1701 nt, Artificial Sequence
  derived and/or modified sequence opt5 from hemagglutinin__InfluenzaA__AFM72257
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaauuauaaguacccugcgcugaacgugacaaugcccaauaacgagaaguuugacaaacucuauaucuggggcguucaccacccuucuaccgauuccgaccagauuagcaucuacgcccaggcuuccggcagagugacggucucuacaaagcggagccagcaaaccgugauuccgaacaucgggucccgccccugggugagaggagucagcucuggcauuuccaucuacuggacaaucguuaaaccuggggauauucugcugaucaauagcaccggaaaccucauugcuccccggggcuauuucaagauccgcucugggaaaagcuccauuaugagaucuaaugccccuaucggaaaguguaacagcgaaugcaucacccccaauggcuccauuccgaacgacaagccuuuucagaaugugaaccggaucacauacggcgccuguccccgcuaugugaaacagaauacgcugaaacuugcgaccgggaugagaaacgucccugagaagcagacacggggaauuuucggcgccaucgcuggguuuauugaaaauggaugggagggcaugguggacgggugguacggauuccgccaucaaaacagcgagggcaccggccaggccgcugaucugaagucuacacaggccgccaucaaucaaaucaacgggaaacucaauagacugauugaaaagaccaacgagaaauuucaccagaucgaaaaggaguucuccgaaguugagggacggauucaggaccuugagaaguauguggaagauacgaaaaucgaccuguggagcuacaacgcugagcuccuggucgcgcuggaaaaucagcauacaauugaucucaccgacucugagaugaacaagcuguucgaaagaacccgcaaacaacuucgggagaaugccgaggauaugggcaacgggugcuuuaagaucuaucacaaaugugacaaugcuugcauuggauccaucagaaacggcacauacgaucacgacguguaccgcgaugaagcccugaauaaccgguuccagaucaaggggguugagcucaagagcggcuauaaagacuggauucuguggaucuccuuugccauuucuugcuuccuucugugugugguccuccugggauuuaucaugugggcuugccagaagggcaauauuagauguaacaucugcaucuga

SEQ ID NO: 192144 - RNA, 1701 nt, Artificial Sequence
  derived and/or modified sequence opt5 from hemagglutinin__InfluenzaA__AFM72268
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaauuauaaguacccugcgcugaacgugacaaugcccaauaacgagaaguuugacaaacucuauaucuggggcguucaccacccuaacaccgauucugaccagauuuccaucuacgcccaggcuagcggcagagugacggucuccacaaagcggucucagcaaaccgugauuccgaauaucgggagccgccccugggugagaggagucuccagcggcauuucuaucuacuggacaaucguuaaaccuggggauauucugcugaucaacuccaccggaaaucucauugcuccccggggcuauuucaagauccgcagcgggaaaucuagcauuaugagauccaacgccccuaucggaaaguguaauucugaaugcaucacccccaacggcagcauuccgaaugacaagccuuuucagaacgugaaucggaucacauacggcgccuguccccgcuaugugaaacagaacacgcugaagcuggcgaccgggaugagaaaugucccugagaaacagacacggggaauuuucggcgccaucgcuggguuuauugaaaacggaugggagggcaugguggacgggugguacggauuccgccaucaaaauuccgagggcaccggccaggccgcugaucuuaagagcacacaggccgccaucaaccaaaucaaugggaaacucaacagacugauugaaaagaccaacgagaaauuucaccagaucgaaaaggaguucucugaaguugagggacggauucaggaccuugagaaguauguggaagauacgaaaaucgaccugugguccuacaaugcugagcuccuggucgcgcuggaaaaccagcauacaauugaucucaccgacagcgagaugaauaagcuguucgaaagaacccgcaaacaacuucgggagaacgccgaggauaugggcaaugggugcuuuaagaucuaucacaaaugugacaacgcuugcauuggaucuaucagaaauggcacauacgaucacgacguguaccgcgaugaagcccugaacaaucgguuccagaucaaggggguugagcucaaguccggcuauaaagacuggauucuguggaucagcuuugccauuuccugcuuccuucugugugugguccuccugggauuuaucaugugggcuugccagaagggcaacauuagauguaauaucugcaucuga

SEQ ID NO: 192145 - RNA, 1701 nt, Artificial Sequence
  derived and/or modified sequence opt5 from hemagglutinin__InfluenzaA__AFM72279
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagcaucuacgcccaggcuuccggcagagugacggucucuacaaaacggagccagcaaaccgugauuccgaacaucggguccaagcauugggugcgcggagucagcucuagaauuuccaucuacuggacaaucguuaaacccggcgauauucugcugaucaacagcaccgggaaucucauugccccucggggauauuucaagauccgcucuggcaagagcuccauuaugagaucuaacgcucccaucgggaaauguaauagcgaaugcaucaccccuaacggauccauucccaaugacaagccguuucagaacgugaaucggaucacauacggcgccuguccucgcuaugugaaacagaacacgcugaaacuugcgaccggcaugagaaauguccccgagaagcagacacgggggauuuucggagccaucgcuggcuuuauugaaaacgggugggagggaaugguggacggcugguacggguuccgccaccaaaauagcgagggaaccggccaggccgcugaucugaagucuacacaggccgccaucaaccaaaucaauggcaaacucaacagacugauugaaaagaccaaugagaaguuucaucagaucgaaaaagaguucuccgaaguugaggggcggauucaggaccuugagaaguauguggaagauacgaaaaucgaccuguggagcuacaacgcugagcuccuggucgcgcuggaaaaccagcacacaauugaucucaccgacucugagaugaauaagcuguucgaaagaacccgcaaacaacuucgggagaacgccgaggauaugggaaauggcugcuuuaagaucuaucacaagugugacaacgcuugcauuggguccaucagaaauggaacauacgaucaugacguguaccgcgaugaagcccugaacaaucgguuccagaucaaaggcguugagcucaagagcggguauaaagacuggauucuguggaucuccuuugccauuucuugcuuccuucugugugugguccuccugggcuuuaucaugugggcuugccagaagggaaacauuagauguaauaucugcaucuga

SEQ ID NO: 192146 - RNA, 1701 nt, Artificial Sequence
  derived and/or modified sequence opt5 from hemagglutinin__InfluenzaA__AFM72290
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaggacaaguauccugcgcugaaugugacaaugcccaacaaugagaaauuugauaagcucuacaucuggggcguucaccacccuucuaccgacuccgaucagauuagcaucuaugcccaggcuuccggcagagugacggucucuacaaaacggagccagcaaaccgugauuccgaacaucggguccaagcauugggugcgcggagucagcucuagaauuuccaucuacuggacaaucguuaaacccggcgacauucugcugaucaacagcaccgggaaucucauugccccucggggauacuucaagauccgcucuggcaagagcuccauuaugagaucuaacgcucccaucgggaaauguaauagcgaaugcaucaccccuaacggauccauucccaaugacaagccguuucagaacgugaaucggaucacauauggcgccuguccucgcuacgugaaacagaacacgcugaaacuugcgaccggcaugagaaauguccccgagaagcagacacgggggauuuucggagccaucgcuggcuuuauugaaaacgggugggagggaaugguggauggcugguauggguuccgccaccaaaauagcgagggaaccggccaggccgcugaccugaagucuacacaggccgccaucaaccaaaucaauggcaaacucaacagacugauugaaaagaccaaugagaaguuucaucagaucgaaaaagaguucuccgaaguugaggggcggauucaggaucuugagaaguacguggaagacacgaaaaucgaucuguggagcuauaacgcugagcuccuggucgcgcuggaaaaccagcacacaauugaccucaccgauucugagaugaauaagcuguucgaaagaacccgcaaacaacuucgggagaacgccgaggacaugggaaauggcugcuuuaagaucuaccacaagugugauaacgcuugcauuggguccaucagaaauggaacauaugaccaugauguguaccgcgacgaagcccugaacaaucgguuccagaucaaaggcguugagcucaagagcggguacaaagacuggauucuguggaucuccuuugccauuucuugcuuccuucugugugugguccuccugggcuuuaucaugugggcuugccagaagggaaacauuagauguaauaucugcaucuga

SEQ ID NO: 192147 - RNA, 1701 nt, Artificial Sequence
  derived and/or modified sequence opt5 from hemagglutinin__InfluenzaA__AFM72301
augaagaccaucauugcccugagcuacauccucugccugguguucucccagaaacuucccggcaacgacaauucuacagcuacgcugugucucgggcaccaugccgucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgauuacgccagccuccggucccugguugcuagcucuggaacgcuugaguuuaacaaugaauccuucaacugggccggcgugacccagaauggcacaagcucugcuugcaagcgcagauccaacaagagcuuuuucucucggcugaauuggcucacccagcugaaauauaaguacccugcccuuaacgucacaaugcccaauaacgagaaauuugacaagcuguauaucuggggagugcaucacccuguuaccgauuccgaccagauuagccucuacgcgcaagccuccgggcgcaucacggugucuacaaaaagaagccagcagaccgucauuccgaacaucggcuaccggccccgcgugagagauauuuccagccggaucucuaucuauuggacaauugugaagccuggggacauccugcugauuaauuccaccggaaaccucaucgcuccccgcggcuacuucaagauuagaagcgggaaaucuagcaucaugcgguccgacgccccuaucggaaaguguaauucugagugcauuacccccaacggcagcaucccgaaugauaaaccuuuucagaacgucaaucgcauuacauauggcgcuugucccagauacguuaagcaaaacacgcugaaacuugccaccgggaugcggaaugugccugaaaagcagacacgcggaaucuucggcgcgauugccggguuuaucgagaacggaugggaaggcaugguggacgggugguauggauucagacaucaaaauuccgagggcaccggccaggcugccgaucugaaaagcacacaggcugccaucaaccagauuaaugggaagcucaaccggcugaucggaaagaccaaugagaaauuucaccagauugaaaaggaguucucugaagucgagggcagaauccaagaccuugaaaaauacguggaggauacgaagauugaccugugguccuauaacgccgagcuccugguugcucuggaaaaccagcacacaaucgaucucaccgacagcgagaugaauaaacuguucgaacgcaccaagaagcagcuucgggagaacgcggaagauauggggaauggaugcuuuaaaauuuaccauaagugugacaacgccugcaucgagucuaucagaaauggcacauacgaucacgacguguaucgcgacgaggcucugaacaaucgguuccagauuaaaggggucgaacucaaguccggcuacaaagauuggauccuguggauuagcuuugccaucuccugcuuccuucuguguguggcccuccugggauuuauuaugugggcuugccaaaagggcaacaucagauguaauaucugcauuuga

SEQ ID NO: 192148 - RNA, 1701 nt, Artificial Sequence
  derived and/or modified sequence opt5 from hemagglutinin__InfluenzaA__AFM72312
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccuguuacggauucugaccagauuaaccucuacgcgcaggccuccgggcgcaucacagugagcaccaaaagaucccaacagacagucauuccgaauaucggcuaccggccccgcgugagagauauuccuucucggaucagcaucuauuggaccauugugaagcccggggacauccugcugauuaacuccaccggaaaucucaucgcuccucgcggcuacuucaagauuagaagcgggaaaucuuccaucaugcggagcgacgcccccaucggaaaguguaacucugagugcauuacaccgaauggcagcaucccuaacgauaaacccuuucagaaugucaaccgcauuacguauggcgcuuguccuagauacguuaagcagaauacccugaaacuugccacagggaugcggaacgugcccgaaaagcaaacccgcggaaucuucggcgcgauugccggguuuaucgagaauggaugggaaggcaugguggacgggugguauggauucagacaccagaacuccgagggcacaggccaggcugccgaucugaaaucuacccaagcugccaucaaucagauuaacgggaagcucaaucggcugaucggaaagacgaacgagaaauuucaccagauugaaaaggaguucagcgaagucgagggcagaauccaggaccuugaaaaauacguggaggauacaaagauugaccugugguccuauaacgccgagcuccugguugcucuggaaaaucaacauaccaucgaucucaccgacagcgagaugaacaaacuguucgaacgcacaaagaagcagcuucgggagaaugcggaagauauggggaacggaugcuuuaaaauuuaccacaagugugacaaugccugcaucggcucuaucagaaacgggaccuacgaucaugacguguaucgcgacgaggcucugaauaaccgguuccagauuaaaggcgucgagcucaaguccggauacaaagauuggauccuguggauuagcuuugccaucucuugcuuccuucuguguguggcccuccugggcuuuauuaugugggcuugccagaaggggaauaucagauguaacaucugcauuuga

SEQ ID NO: 192149 - RNA, 1701 nt, Artificial Sequence
  derived and/or modified sequence opt5 from hemagglutinin__InfluenzaA__AFM72323
augaaggccaucauugcucugagcuacauccucugccugguguucgcccagaaacuucccggcaacgacaauuccaccgcgacacugugucucgggcaccaugcugucccuaacggaacgauuguuaagaccaucacaaaugaucaaauugaggugaccaacgccacagaacuggugcagucuagcuccaccggcgggaucugcgacucuccgcaccagauccuugauggagagaauuguacacugauugacgcccuccugggcgauccccagugcgacggguuucaaaacaaaaagugggaucuguucgucgaaagaagcaaggcuuauuccaauuguuacccuuaugacgugcccgauuacgccucucuccggagccugguugcuuccagcggaacccuugaguuuaacaaugaaucuuucaacuggacgggcgugacccagaauggcacauccagcgccugcaaacgcagaucuaacaaguccuuuuucagccggcugaauuggcucacccaucugaaauauaaguacccugcgcuuaacgucacaaugcccaauaacgagaaauuugacaagcuguauaucuggggagugcaccauccuguuaccgauucugaccagauuaaccucuacgcccaggcuuccgggcgcaucacggugagcacaaaaagaucccaacagaccgucauuccgaauaucggcuaccggccccgcgugagagauaacccuucucggauuagcaucuauuggacaaucgugaagcccggggacauucugcugaucaauuccaccggaaaccucauugccccucgcggcuacuucaagaucagaagcgggaaaucuuccauuaugcggagcgacgcucccaucggaaaguguaauucugagugcaucaccccgaacggcagcauuccuaaugauaaacccuuucagaacgucaaucgcaucacauauggcgccuguccuagauacguuaagcagaacacgcugaaacuugcgaccgggaugcggaaugugcccgaaaagcaaacacgcggaauuuucggcgccaucgcuggguuuauugagaacggaugggaaggcaugguggacgggugguauggauucagacaccaaaauuccgagggcaccggccaggccgcugaucugaaaucuacacaggccgccaucaaccagaucaaugggaagcucaaccggcugauuggaaagaccaacgagaaauuucaccagaucgaaaaggaguucagcgaagucgagggccgcauucaggaccuugaaaaauacguggaggauacgaagaucgaccugugguccuauaaugcugagcuccugguugcgcuggaaaaccaacauacaauugaucucaccgacagcgagaugaauaaacuguucgaaagaaccaagaagcagcuucgggagaacgccgaagauauggggaauggaugcuuuaaaaucuaccacaagugugacaacgcuugcauuggcucuaucagaaaugggacauacgaucaugacguguaucgcgacgaggcccugaacaaucgguuccagaucaaaggcgucgagcucaaguccggauacaaagauuggauucuguggaucagcuuugccauuucuugcuuccuucuguguguggcucuccugggcuuuaucaugugggccugccagaaggggaacauuagauguaauaucugcaucuga

SEQ ID NO: 192150 - RNA, 1701 nt, Artificial Sequence
  derived and/or modified sequence opt5 from hemagglutinin__InfluenzaA__AFM72334
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcuccauccugggacguacaaagaccagaucuuucuguaugcgcaagccucuggacgcauuacaguuuccaccaagagaagccagcaggcugugaucccgaauauuggcucccggccccgcgucagaaacaucccuucucgggugagcaucuacuggacaauugugaaacccggggauauccugcucauuaauuccaccggaaaccugaucgccccucgcggcuacuucaagauuagaagcgggaaaucuuccaucaugcggagcgacgcucccaucggaaaguguaauucugccugcauuaccccgaacggcagcaucccuaaugauaagcccuuucagaacgucaaucgcauuacauauggcgcguguccuagauacguuaaacaaaacacgcuuaagcuggccaccgggaugcggaaugugcccgaaaaacagacacgcggaaucuucggcgcuauugccggguuuaucgagaacggaugggaaggcaugguggacgggugguauggauucagacaccaaaauuccgagggccggggccaggcugccgaccucaagucuacccaggccgcuaucgaucagauuaacgggaaacugaacagacuuaucggaaagacaaaugagaaauuccaccagauugaaaaggaguuuagcgaagucgagggccgcauccaagaccuggaaaaguacguggaggauaccaaaauugaccucugguccuauaacgcggagcugcugguugcccucgaaaaucagcauacgaucgaucugacagacagcgagaugaacaaacuuuucgaaaagaccaagaaacagcugcgggagaaugcugaagauauggggaacggaugcuuuaagauuuaccacaagugugacaaugccugcaucggcucuaucagaaacgggaccuaugaucaugacguguaccgcgaugaggcccucaauaaccgguuccagauuaaaggcgucgagcugaaguccggauacaaagacuggauccuuuggauuagcuuugcuaucucuugcuuccugcucuguguggcccugcugggcuuuauuaugugggcgugccaaaaggggaauaucagauguaacaucugcauuuga

SEQ ID NO: 192151 - RNA, 1701 nt, Artificial Sequence
  derived and/or modified sequence opt5 from hemagglutinin__InfluenzaA__AFM72345
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccuguuacggacucugaucagauuucccucuacacacaggcgagcgggcgcaucaccguguccacaaaaagaucucaacagaccgucauuccgaacaucggcuuccggccccgcgugagagacauuagcucccggaucagcaucuacuggaccauugugaagccuggggacauccugcugauuaacucuacaggaaaucucaucgcuccccgcggcuauuuuaagauuagauccgggaaaagcucuaucaugcggagcgaugccccuaucggaaaguguaacuccgagugcauuacgcccaauggcucuaucccgaacgacaaaccuuuccagaaugucaaccgcauuaccuacggcgccugucccagauauguuaagcagaauacacugaaacuugcuaccgggaugcggaacgugccugaaaagcaaacacgcggaaucuuuggcgccauugcgggguucaucgagaauggaugggaaggcaugguggaugggugguacggauuuagacaccagaacagcgagggcaccggccaggccgcugaccugaaauccacgcaagccgcuaucaaucagauuaacgggaagcucaaucggcugaucggaaagacaaacgagaaauuccaccagauugaaaaggaguucagcgaagucgagggcagaauccaggaucuugaaaaauauguggaggacaccaagauugaucuguggucuuacaaugccgagcuccugguugcccuggaaaaccaacauaccaucgaccucacagauuccgagaugaacaaacuguuugaacgcaccaagaagcagcuucgggagaaugcugaagacauggggaacggaugcuucaaaauuuaucacaagugugauaaugcgugcaucggcagcaucagaaacgggacauacgaccaugacguguaccgcgaugaggcccugaauaaccgguuucagauuaaaggcgucgagcucaagucuggauauaaagacuggauccuguggauuuccuucgcuaucagcugcuuucuucuguguguggcccuccugggcuucauuaugugggccugccagaaggggaauaucagauguaacaucugcauuuga

SEQ ID NO: 192152 - RNA, 1701 nt, Artificial Sequence
  derived and/or modified sequence opt5 from hemagglutinin__InfluenzaA__AFM72356
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuaaucucuauguucaggcgucuggccgcaucacaguguccaccaaaagaagccaacagacagucauuccgaacaucgggucccggccccgcgugagagaugugccuucucggauuagcaucuacuggaccaucgucaagcccggagacauucugcugaucuccagcaccggcaaucucauugccccucgcggguacuuuaagaucagaucuggaaaauccagcauuaugcggucugacgcucccaucggcaaguguaacagcgagugcaucacaccgaauggcuccauuccuaacgauaaacccuuccagaauguuaaccgcaucacguauggggccuguccuagauacgugaagcagaauacccugaaacuugcuacaggaaugcggaacgugcccgaaaagcaaacccgcggcauuuuuggggccaucgcgggauucauugagaauggcugggaagggauggucgacggaugguauggcuuuagacaccagaacucugagggcacagggcaggccgcugaucugaaaagcacccaagccgcuaucaaucagaucaacggaaagcucaaucggcugauuggcaagacgaacgagaaauuccaccagaucgaaaaggaguucuccgaaguggaggggcgcauucaggaccuugaaaaauacguugaggauacaaagaucgaccuguggagcuauaacgccgagcuccugguggcccuggaaaaucaacauaccauugaucucaccgacucugagaugaacaaacuguuugaaagaacaaagaagcagcuucgggagaaugcugaagauaugggaaacggcugcuucaaaaucuaccacaagugugacaaugcgugcauuggguccaucagaaacggcaccuaugaucaugacgucuaccgcgacgaggcccugaauaaccgguuucagaucaaaggaguggagcucaagagcggcuacaaagauuggauucuguggaucucuuucgcuauuuccugcuuucuucuguguguugcccuccugggguucaucaugugggccugccagaagggaaauauuagauguaacaucugcaucuga

SEQ ID NO: 192153 - RNA, 1701 nt, Artificial Sequence
  derived and/or modified sequence opt5 from hemagglutinin__InfluenzaA__AFM72367
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccuguuacggauaacgaccagauuaaucucuaugcgcaggccucugggcgcaucacaguguccaccaaaagaagccaacagacagucauuccgaacaucggcucccggccccgcgugagagaugugccuucucggauuagcaucuacuggaccaucgucaagcccggggacauucugcugaucuccagcaccggaaaucucauugcuccucgcggcuacuuuaagaucagaucugggaaauccagcauuaugcggucugacgcccccaucggaaaguguaacagcgagugcaucacaccgaauggcuccauuccuaacgauaaacccuuccagaauguuaaccgcaucacguauggcgcuuguccuagauacgugaagcagaauacccugaaacuugccacagggaugcggaacgugcccgaaaagcaaacccgcggaauuuuuggcgcgaucgccggguucauugagaauggaugggaaggcauggucgacgggugguauggauuuagacaccagaacucugagggcacaggccaggcugccgaucugaaaagcacccaagcugccaucaaucagaucaacgggaagcucaaucggcugauuggaaagacgaacgagaaauuccaccagaucgaaaaggaguucuccgaaguggagggccgcauucaggaccuugaaaaauacguugaggauacaaagaucgaccuguggagcuauaacgccgagcuccugguggcucuggaaaaucaacauaccauugaucucaccgacucugagaugaacaaacuguuugaaagaacaaagaagcagcuucgggagaaugcggaagauauggggaacggaugcuucaaaaucuaccacaagugugacaaugccugcauuggcuccaucagaaacgggaccuaugaucaugacgucuaccgcgacgaggcucugaauaaccgguuucagaucaaaggcguggagcucaagagcggauacaaagauuggauucuguggaucucuuucgccauuuccugcuuucuucuguguguugcccuccugggcuucaucaugugggcuugccagaaggggaauauuagauguaacaucugcaucuga

SEQ ID NO: 192154 - RNA, 1701 nt, Artificial Sequence
  derived and/or modified sequence opt5 from hemagglutinin__InfluenzaA__AFM72378
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacagcugaacuuuaaguacccugcccuuaacgucaccaugcccaauaacgagcaguucgauaagcuguauauuuggggcgugcaccauccuguuacggacaaagaucaaaucuuucucuacgcgcaggccucugggcgcauuacaguguccaccaagagaagccagcaggcugucaucccgaauauuggauaucggccccgcgugagaaacaucccuucccgggugucuaucuacuggacaauugucaaacccggcgacauccugcugauuaauagcaccgggaaccucaucgccccucgcggauacuucaagauuagauccggcaaaagcucuaucaugcgguccgaugcucccaucgggaaguguaauagcgccugcauuaccccgaacggaucuaucccuaaugacaagcccuuucaaaacguuaaucgcauuacauauggcgcguguccuagauacgugaaacagaacacgcugaaacuugccaccggcaugcggaaugugcccgaaaaacagacacgcgggaucuucggagcuauugccggcuuuaucgagaacgggugggaaggaauggucgacggcugguauggguucagacaccaaaauagcgagggacggggccaggcugccgaucugaaguccacccaggccgcuaucgaccagauuaacggcaaacucaacagacugaucgggaagacaaaugagaaauuccaccaaauugaaaaggaguuuucugaaguggagggacgcauccaggaucuugaaaaguacguugaggacaccaaaauugaucuguggagcuauaacgcggagcuccugguggcccuggaaaaucagcauacgaucgaccucacagauuccgagaugaacaagcuguucgaaaagaccaagaaacagcuucgggagaaugcugaagacaugggcaacgggugcuuuaagauuuaccacaagugugauaaugccugcaucggaagcaucagaaacggcaccuaugaccaugaugucuaccgcgacgaggcccugaauaaccgguuccaaauuaaagggguggagcucaagucuggcuacaaagacuggauccuguggauuuccuuugcuaucagcugcuuccuucuguguguugcccuccugggauuuauuaugugggcgugccagaagggcaauaucagauguaacaucugcauuuga

SEQ ID NO: 192155 - RNA, 1701 nt, Artificial Sequence
  derived and/or modified sequence opt5 from hemagglutinin__InfluenzaA__AFM72389
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccuguuacggacaaagaucagaucuuucucuacgcgcaagccucugggcgcauuacaguguccaccaagagaagccagcaggcugucaucccgaauauuggauaucggccccgcgugagaaacaauccuucccgggugucuaucuacuggacaaucgucaaacccggcgacauucugcugaucaacagcaccgggaaucucauugccccucgcggauacuucaagaucagauccggcaaaagcucuauuaugcgguccgaugcucccaucgggaaguguaacagcgccugcaucaccccgaauggaucuauuccuaacgacaagcccuuucagaauguuaaccgcaucacauauggcgcguguccuagauacgugaaacaaaauacgcugaaacuugccaccggcaugcggaacgugcccgaaaaacagacacgcgggauuuucggagcuaucgccggcuuuauugagaaugggugggaaggaauggucgacggcugguauggguucagacaccagaacagcgagggacggggccaagcugccgaucugaaguccacccaggccgcuaucgaccagaucaacggcaaacucaauagacugauugggaagacaaacgagaaauuccaucagaucgaaaaggaguuuucugaaguggagggacgcauucaagaucuugaaaaguacguugaggacaccaaaaucgaucuguggagcuauaaugcggagcuccugguggcccuggaaaaccagcacacgauugaccucacagauuccgagaugaauaagcuguucgaaaagaccaagaaacagcuucgggagaacgcugaagacaugggcaaugggugcuuuaagaucuaccauaagugugauaacgccugcauuggaagcaucagaaauggcaccuaugaccacgaugucuaccgcgacgaggcccugaacaaucgguuccagaucaaagggguggagcucaagucuggcuacaaagacuggauucuguggaucuccuuugcuauuagcugcuuccuucuguguguugcccuccugggauuuaucaugugggcgugccaaaagggcaacauuagauguaauaucugcaucuga

SEQ ID NO: 192156 - RNA, 1701 nt, Artificial Sequence
  derived and/or modified sequence opt5 from hemagglutinin__InfluenzaA__AFM72400
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgagaucugcgacucuccgcaccagauucuugauggggaaaacuguacccugaucgacgcccuccugggagauccccagugcgacggcuuucaaaauaaaaagugggaucuguucgucgagagaagcaaagccuauuccaacuguuacccuuaugacgugcccgauuacgcuucucuccggagccugguugccuccagcgggacgcuugaauuuaauaacgagucuuucaauugggcuggagugacccagaacggcacauccagcgccugcaagcgcggcucuaauaacuccuuuuucagcagacugaauuggcucacccauucuaaguuuaaauauccugcgcugaacgucacaaugcccaauaacgaggaguucgacaaacuuuacauuuggggagugcugcacccugggaccgauaacgaccagaucuuucucuaugcccaggcuuccggccggauuacgguuagcacaaagcgcucccaacagaccgugaucccgaauauugggucuagaccccggguccgcaacaucccuagcagaaucuccauuuacuggacaaucgugaagcccggagauauucugcugaucaauagcaccggcaaccucauugccccucggggguacuucaaaauccgcucuggaaaguccagcaucaugagaucugacgcucccauuggcaaguguaauagcgaaugcaucaccccgaacggcuccauuccuaaugacaaacccuuucagaacgugaaucggaucacauauggggccuguccucgcuacgucaagcagaacacgcugaaacuugcgaccggaaugagaaauguucccgaaaagcaaacacggggcauuuucggggccaucgcuggauuuaucgagaacggcugggaggggaugguggauggaugguauggcuuccgccaucaaaauucugaaggcauugggcaggccgcugaccugaaaagcacccaggccgccaucgaucagauuaacggaaagcucaauagacugaucggcaaaacaaacgagaaguuccaccagauugaaaaggaguuuuccgaaguggaggggcggauccaggaccuugagaaauacgucgaagauaccaagauugaccuguggagcuauaacgcugagcuccugguggcgcuggaaaaucaacacacgaucgaucucacagacucugagaugaacaaacuguucgaaaagaccaaaaagcagcuuagagagaaugccgaggauaugggaaacggcugcuuuaagaucuaccauaaaugugacaaugcuugcauuggguccauccgcaacggcaccuaugaucacgacguuuaccgggacgaagcccugaauaacagauuccagauuaagggaguggagcucaaaagcggcuacaaggauuggauccuguggauuucuuuugccaucuccugcuuccuucugugugucgcucuccugggguuuaucaugugggccugccagaaaggaaauauucgcuguaacaucugcauuuga

SEQ ID NO: 192157 - RNA, 1701 nt, Artificial Sequence
  derived and/or modified sequence opt5 from hemagglutinin__InfluenzaA__AFM72411
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgagaucugcgacucuccgcaccagauucuugauggggaaaacuguacccugaucgacgcccuccugggagauccccagugcgacggcuuucaaaauaaaaagugggaucuguucgucgagagaagcaaagccuauuccaacuguuacccuuaugacgugcccgauuacgcuucucuccggagccugguugccuccagcgggacgcuugaauuuaauaacgagucuuucaauugggcuggagugacccagaacggcacauccagcgccugcaagcgcggcucuaauaacuccuuuuucagcagacugaauuggcucacccagucuaaguuuaaauauccugcgcugaacgucacaaugcccaauaacgaggaguucgacaaacuuuacauuuggggagugcaucacccuguuaccgauaacgaccagaucuuucuguaugcccaggcuuccgggcggauuacggugagcacaaagcgcucccagcagaccgucaucccgaauauuggcucuagaccccgggugcgcaacaucccuagcagaaucuccauuuacuggacaaucgugaagcccggggauauucuccugaucaauagcaccggaaaccugauugccccucggggcuacuucaaaauccgcucugggaaguccagcaucaugagaucugacgcucccauuggaaaguguaauagcgaaugcaucaccccgaacggcuccauuccuaaugacaaacccuuucagaacgucaaucggaucacauauggcgccuguccucgcuacguuaagcaaaacacgcucaaacuggcgaccgggaugagaaaugugcccgaaaagcagacacggggaauuuucggcgccaucgcuggguuuaucgagaacggaugggagggcaugguggaugggugguauggauuccgccaucaaaauucugaaggcauuggccaagccgcugaccuuaaaagcacccaggccgccaucgaucagauuaacgggaagcugaauagacucaucggaaaaacaaacgagaaguuccaccagauugaaaaggaguuuuccgaagucgagggccggauccaagacuucgagaaauacguggaagauaccaagauugaccuguggagcuauaacgcugagcuucugguugcgcucgaaaaucagcacacgaucgaucugacagacucugagaugaacaaacuguuugaaaagaccaaaaagcagcucagagagaaugccgaggauauggggaacggaugcuucaagaucuaccauaaaugugacaaugcuugcauuggcuccauccgcaacgggaccuaugaucacgacguguaccgggacgaagcccugaauaacagauuucagauuaagggcgucgagcuuaaaagcggauacaaggauuggauccuguggauuucuuucgccaucuccugcuuucuccuguguguggcccuucugggcuucaucaugugggcuugccaaaaagggaauauucgcuguaacaucugcauuuga

SEQ ID NO: 192158 - RNA, 1701 nt, Artificial Sequence
  derived and/or modified sequence opt5 from hemagglutinin__InfluenzaA__AFM72422
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccuguuacggauaaugaccagaucuuucucuaugcgcaggccucugggcgcauuacaguguccaccaagagaagccaacagacagucaucccgaacauuggauuccggccccgcgugagaaauaucccuucccggaucucuauuuacuggaccaucgugaaacccggcgauauucugcugaucaacagcaccgggaaucucauugcuccucgcggauacuuuaagaucagauccggcaaaagcucuaucaugcgguccgacgcccccauugggaaguguaacagcgaaugcaucacaccgaauggaucuauuccuaacgacaagcccuuccagaaugucaaccgcaucacguauggcgcuuguccuagauacguuaaacagaauacccugaaacuugccacaggcaugcggaacgugcccgaaaaacaaacccgcgggauuuuuggagcgaucgccggcuucaucgagaaugggugggagggaaugguggauggcugguauggguucagacaccagaacagcgaaggaauuggccaggcugccgaccugaaguccacacaagcugccaucgaucagauuaauggcaaacucaaccggcugaucgggaagaccaacgagaaauuucaccagauugaaaaggaguucucugaagucgagggaagaauccaggaccuugagaaguacgccgaagauacgaaaauugaccuguggagcuauaaugcugagcuccugguggcgcuggaaaaccaacauacaaucgaucucaccgacuccgagaugaauaagcuguuugaaaagaccaagaaacagcuucgcgagaacgccgaggauaugggcaaugggugcuucaagaucuaccacaagugugacaacgcuugcauuggaagcauccggaauggcacauaugaucaugacguuuacagagacgaagcccugaacaaucgcuuucagauuaaagggguggagcucaagucuggcuacaaagauuggauccuguggauuuccuucgccaucagcugcuuucuucugugugucgcucuccugggauucaucaugugggccugccagaagggcaacauucgguguaauaucugcauuuga

SEQ ID NO: 192159 - RNA, 1701 nt, Artificial Sequence
  derived and/or modified sequence opt5 from hemagglutinin__InfluenzaA__AFM72433
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccuguuacggauaaugaccagaucuuucucuaugcgcaggccucugggcgcauuacaguguccaccaagagaagccaacagacagucaucccgaacauuggauuccggccccgcgugagaaauaacccuucccggaucucuaucuacuggaccauugugaaacccggcgauauccugcugauuaauagcaccgggaaccucaucgcuccucgcggauacuuuaagauuagauccggcaaaagcucuaucaugcgguccgacgcccccaucgggaaguguaauagcgaaugcauuacaccgaacggaucuaucccuaaugacaagcccuuccagaacgucaaucgcauuacguauggcgcuuguccuagauacguuaaacagaacacccugaaacuugccacaggcaugcggaaugugcccgaaaaacaaacccgcgggaucuuuggagcgauugccggcuucaucgagaacgggugggagggaaugguggauggcugguauggguucagacaccagaauagcgaaggaaucggccaggcugccgaccugaaguccacacaagcugccauugaucagaucaacggcaaacucaaccggcugauugggaagaccaaugagaaauuucaccagaucgaaaaggaguucucugaagucgagggacgcauucaggaccuugagaaguacgccgaagauacgaaaaucgaccuguggagcuauaacgcugagcuccugguggcgcuggaaaaucaacauacaauugaucucaccgacuccgagaugaacaagcuguuugaaaagaccaagaaacagcuuagagagaaugccgaggauaugggcaacgggugcuucaagaucuaccacaagugugacaaugcuugcaucggaagcauucggaacggcacauaugaucaugacguuuacagagacgaagcccugaauaaccgcuuucagaucaaagggguggagcucaagucuggcuacaaagauuggauucuguggaucuccuucgccauuagcugcuuucuucugugugucgcucuccugggauucaucaugugggccugccagaagggcaauauccgguguaacauuugcaucuga

SEQ ID NO: 192160 - RNA, 1701 nt, Artificial Sequence
  derived and/or modified sequence opt5 from hemagglutinin__InfluenzaA__AFM72444
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccuguuacggauaaugaccagauccuccuguaugcgcaggccucugggcgcauuacaguguccaccaagagaagccaacagacagucaucccgaacauuggauuucggccccgcgugagaaauaacccuucccggaucucuaucuacuggaccauugugaaacccggcgauauccugcucauuaauagcaccgggaaccugaucgcuccucgcggauacuucaagauuagauccggcaaaagcucuaucaugcgguccgacgcccccaucgggaaguguaauagcgaaugcauuacaccgaacggaucuaucccuaaugacaagcccuuucagaacgucaaucgcauuacguauggcgcuuguccuagauacguuaaacagaacacccuuaagcuggccacaggcaugcggaaugugcccgaaaaacaaacccgcgggaucuucggagcgauugccggcuuuaucgagaacgggugggagggaaugguggauggcugguauggguucagacaccagaauagcgaaggaaucggccaggcugccgaccucaaguccacacaagcugccauugaucagaucaacggcaaacugaaccggcuuauugggaagaccaaugagaaauuccaccagaucgaaaaggaguuuucugaagucgagggacgcauucaggaccuggagaaguacgccgaagauacgaaaaucgaccucuggagcuauaacgcugagcugcugguggcgcucgaaaaucaacauacaauugaucugaccgacuccgagaugaacaaacuuuucgaaaagaccaagaaacagcugagagagaaugccgaggauaugggcaacgggugcuuuaagaucuaccacaagugugacaaugcuugcaucggaagcauucggaacggcacauaugaucaugacguuuacagagacgaagcccucaauaaccgcuuccagaucaaagggguggagcugaagucuggcuacaaagauuggauucuuuggaucuccuuugccauuagcugcuuccugcucugugucgcucugcugggauuuaucaugugggccugccagaagggcaauauccgguguaacauuugcaucuga

SEQ ID NO: 192161 - RNA, 1701 nt, Artificial Sequence
  derived and/or modified sequence opt5 from hemagglutinin__InfluenzaA__AFM72455
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacagcugaaguuuaaguauccugcccuuaaugucaccaugcccaacaacgaggaguucgacaaacuguacauuuggggcgugcaucacccuguuacggauaaugaccagaucuuucucuaugcgcaagccucugggcgcauuacaguguccaccaagagaagccagcagacagucaucccgaacauuggauuccggccccgcgugagaaauaacccuucccggaucucuaucuacuggaccauugugaaacccggcgauauccugcugauuaauagcaccgggaaccucaucgcuccucgcggauacuuuaagauuagauccggcaaaagcucuaucaugcgguccgacgcccccaucgggaaguguaauagcgaaugcauuacaccgaacggaucuaucccuaaugacaagcccuuccagaacgucaaucgcauuacguauggcgcuuguccuagauacguuaaacaaaacacccugaaacuugccacaggcaugcggaaugugcccgaaaaacagacccgcgggaucuuuggagcgauugccggcuucaucgagaacgggugggagggaaugguggauggcugguauggguucagacaucagaauagcgaaggaaucggccaagcugccgaccugaaguccacacaggcugccauugaucagaucaacggcaaacucaaccggcugauugggaagaccaaugagaaauuucaccagaucgaaaaggaguucucugaagucgagggacgcauucaagaccuugagaaguacgccgaagauacgaaaaucgaccuguggagcuauaacgcugagcuccugguggcgcuggaaaaucagcacacaauugaucucaccgacuccgagaugaacaagcuguuugaaaagaccaagaaacagcuuagagagaaugccgaggauaugggcaacgggugcuucaagaucuaccauaagugugacaaugcuugcaucggaagcauucggaacggcacauaugaucacgacguuuacagagacgaagcccugaauaaccgcuuucagaucaaagggguggagcucaagucuggcuacaaagauuggauucuguggaucuccuucgccauuagcugcuuucuucugugugucgcucuccugggauucaucaugugggccugccaaaagggcaauauccgguguaacauuugcaucuga

SEQ ID NO: 192162 - RNA, 1701 nt, Artificial Sequence
  derived and/or modified sequence opt5 from hemagglutinin__InfluenzaA__AFM72466
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccuguuacggauaaggaccagaucuuucucuaugcgcaggccucugggcgcauuacaguguccaccaaaagaagccaacagacagucaucccgaauauuggauuccggccccgcgugagaaacaauccuucccggaucucuaucuacuggaccauugugaagcccggcgauauccugcugauuaacagcaccgggaaucucaucgcuccucgcggauacuuuaaaauuagauccggcaagagcucuaucaugcgguccgacgcccccaucgggaaguguaacagcgaaugcauuacaccgaauggaucuaucccuaacgacaaacccuuccagaaugucaaccgcauuacguauggcgcuuguccuagauacguuaagcagaauacccugaaacuugccacaggcaugcggaacgugcccgaaaagcaaacccgcgggaucuuuggagcgauugccggcuucaucgagaaugggugggagggaaugguggauggcugguauggguucagacaccagaacagcgaaggaaucggccaggcugccgaccugaaauccacacaagcugccauugaucagaucaauggcaagcucaaccggcugauugggaaaaccaacgagaaguuucaccagaucgaaaaggaguucucugaagucgagggacgcauucaggaccuugagaaauacgccgaagauacgaagaucgaccuguggagcuauaaugcugagcuccugguggcgcuggaaaaccaacauacaauugaucucaccgacuccgagaugaauaaacuguuugaaaagaccaaaaagcagcuuagagagaacgccgaggauaugggcaaugggugcuucaagaucuaccacaaaugugacaacgcuugcaucggaagcauucggaauggcacauaugaucaugacguuuacagagacgaagcccugaacaaucgcuuucagaucaaggggguggagcucaaaucuggcuacaaggauuggauucuguggaucuccuucgccauuagcugcuuucuucugugugucgcucuccugggauucaucaugugggccugccagaaaggcaacauccgguguaauauuugcaucuga

SEQ ID NO: 192163 - RNA, 1701 nt, Artificial Sequence
  derived and/or modified sequence opt5 from hemagglutinin__InfluenzaA__AFM72488
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacagcugaaguuuaaauauccugcccuuaaugucaccaugcccaacaacgagaaguucgacaaacuguacaucuggggagugcaucacccuguuacggauaaugagcagauuuuucucuaugcgcaagccucugggcgcaucacaguguccaccaagagaagccagcagacagucauuccgaacaucggcuuccggccccgcgugagaaauauuccuucccggaucucuaucuacuggaccauugugaaacccggggacauccugcugauuaacagcaccggaaaucucaucgcuccucgcggcuacuuuaagauuagauccggaaagagcucuaucaugcgguccgaugcccccaucgggaaauguaacagcaagugcauuacaccgaauggcucuaucccuaacgacaaacccuuccagaaugucaaccgcauuacguauggcgcuuguccuagauacguuaagcaaaauacccugaaacuugccacagggaugcggaacgugcccgaaaagcagacccgcggaaucuuuggcgcgauugccggguucaucgagaauggaugggaaggcaugguggacgggugguauggauucagacaucagaacagcgagggcaucggccaagcugccgaucugaaauccacacaggcugccauugaccagaucaaugggaagcucaaccggcugauuggaaagaccaacgagaaauuucaccagaucgaaaaggaguucucugaagucgagggccgcauucaagaucuugaaaaauacguggaggacacgaagaucgaucuguggagcuauaaugccgagcuccugguugcucuggaaaaccagcacacaauugaccucaccgauuccgagaugaauaaacuguuugaaaagaccaagaaacagcuuagagagaacgcggaagacauggggaauggaugcuucaagaucuaccauaaaugugauaacgccugcaucggcagcauucggaaugggacauaugaccacgauguguacagagacgaggcucugaacaaucgcuuucagaucaagggcgucgagcucaaaucuggauacaaggacuggauucuguggaucuccuucgccauuagcugcuuucuucuguguguggcccuccugggcuucaucaugugggcuugccaaaaggggaacauccgguguaauauuugcaucuga

SEQ ID NO: 192164 - RNA, 1701 nt, Artificial Sequence
  derived and/or modified sequence opt5 from hemagglutinin__InfluenzaA__AFM72499
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacagcugaaguuuaaauauccugcccuuaaugucaccaugcccaacaacgagaaguucgacaaacuguacaucuggggagugcaucacccuguuacggauaaugaccagauuuuucucuaugcgcaagccucugggcgcaucacaguguccaccaagagaagccagcagacagucauuccgaacaucggcucccggccccgcgugagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugagugcauuacaccgaauggcagcaucccuaacgacaagcccuuucagaaugucaaccgcauuacguauggcgcuuguccuagauacguuaaacaaaauacccugaaacuugccacagggaugcggaacgugcccgaaaaacagacccgcggaaucuucggcgcgauugccggguuuaucgagaauggaugggaaggcaugguggaugggugguauggauucagacaucagaacuccgagggcaucggccaagcugccgaccugaagucuacacaggcugccauugaucagaucaaugggaaacucaaccggcugauuggaaagaccaacgagaaguuccaccagaucgaaaaagaguuuagcgaagucgagggccgcauucaagaccuugaaaaguacguggaggauacgaaaaucgaccugugguccuauaaugccgagcuccugguugcucuggaaaaccagcacacaauugaucucaccgacagcgagaugaauaagcuguucgaaaagaccaagaagcagcuuagagagaacgcggaagauauggggaauggaugcuuuaaaaucuaccauaagugugacaacgccugcaucggcucuauucggaaugggacauaugaucacgacguguacagagacgaggcucugaacaaucgcuuccagaucaaaggcgucgagcucaaguccggauacaaagauuggauucuguggaucagcuuugccauuucuugcuuccuucuguguguggcccuccugggcuuuaucaugugggcuugccaaaaggggaacauccgguguaauauuugcaucuga

SEQ ID NO: 192165 - RNA, 1698 nt, Artificial Sequence
  derived and/or modified sequence opt5 from hemagglutinin__InfluenzaA__AFM72521
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggagacuuugccugcucaaaggaaucgcgccccugcagcugggcaacuguagcguugcuggguggauucucggaaauccugagugcgaacugcuuaucuccaaggagucuuggagcuacauuguggaaaaaccgaaccccgagaauggcaccuguuauccugggcauuuugccgauuacgaggaacugcgggagcaacucuccucugucagcucccuggaacgcuucgagaucuuucccaaggagagcucuuggccuaaccacacggugaccggaguuuccgccagcugcucucauaauggcgaauccagcuucuauagaaaccuucuguggcucacaggcaagaaugggcuguaccccaaccugucuaaauccuaugcuaauaacaaggagaaagaagugcucguccuguggggagugcaccacccuccgaacaucggcaaucagaaggcccuuuaccauaccgagaacgcuuacgugagcgucguuuccucucacuauagccggaaauuuacacccgaaauugccaagcgcccuaaggugagagaccaggaggggcggaucaauuacuauuggacccugcucgagcccggagauacgauuaucuucgaagcgaacggcaaucugauugccccucgcuacgcuuuugcccuuuccagaggguucggaagcggcaucauuaacucuaaugcucccauggacaaaugugaugccaagugccagacaccgcaaggcgcgaucaacuccagccugccuuuucagaaugugcaucccgucaccaucggggaguguccuaaauaugugcggucugccaagcuccgcaugguuacaggacugagaaacauucccagcauccagucccggggccuguucggggcuauugccggauuuaucgaaggcggguggaccggaaugguggacggcugguacggcuaucaccaccagaaugagcaagggucuggauacgcugccgaucagaaaagcacccagaacgccauuaauggcaucacaaacaaggucaauuccgugaucgagaaaaugaacacgcaguucaccgcuguugggaaggaauuuaacaagcucgagcgcagaauggaaaaucugaacaaaaagguggacgauggauucauugacaucuggacauacaaugcggagcuucugguccuccuggaaaacgagcggacccuugauuuccaugacagcaaugugaaaaaccuguaugaaaaggucaaaucucaacucaagaauaacgccaaggagauuggcaaugggugcuuugaguucuaccacaaauguaacgacgaaugcauggaguccgugaagaauggcacauaugauuaccccaaauauagcgaagagucuaagcugaaccgcgagaaaaucgacggaguuaagcuggaauccaugggcguguaccagauucucgcuaucuauagcaccgucgccuccucucuggugcuucugguuagccucggggccaucuccuuuuggaugugcucuaauggaagccugcaguguagaauuugcaucuga

SEQ ID NO: 192166 - RNA, 1698 nt, Artificial Sequence; identical to SEQ ID NO: 192165
  derived and/or modified sequence opt5 from hemagglutinin__InfluenzaA__AFM72532

SEQ ID NO: 192167 - RNA, 1698 nt, Artificial Sequence; identical to SEQ ID NO: 192165
  derived and/or modified sequence opt5 from hemagglutinin__InfluenzaA__AFM72543

SEQ ID NO: 192168 - RNA, 1698 nt, Artificial Sequence
  derived and/or modified sequence opt5 from hemagglutinin__InfluenzaA__AFM72554
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggagacuuugccugcucaaaggaaucgcgccccugcagcugggcaacuguagcguugcuggguggauucucggaaauccugagugcgaacugcuuaucuccaaggagucuuggagcuacauuguggaaaaaccgaaccccgagaauggcaccuguuauccugggcauuuugccgauuacgaggaacugcgggagcaacucuccucugucagcucccuggaacgcuucgagaucuuucccaaggagagcucuuggccuaaccacacggugaccggaguuuccgccagcugcucucauaauggcgaauccagcuucuauagaaaccuucuguggcucacaggcaagaaugggcuguaccccaaccugucuaaauccuaugcuaauaacaaggagaaagaagugcucguccuguggggagugcaccacccuccgaacaucggcaaucagaaggcccuuuaccauaccgagaacgcuuacgugagcgucguuuccucucacuauagccggaaauuuacacccgaaauugccaagcgcccuaaggugagagaccaggaggggcggaucaauuacuauuggacccugcucgagcccggagauacgauuaucuucgaagcgaacggcaaucugauugccccucgcuacgcuuuugcccuuuccagaggguucggaagcggcaucauuaacucuaaugcucccauggacaaaugugaugccaagugccagacaccgcaaggcgcgaucaacuccagccugccuuuucagaaugugcaucccgucaccaucggggaguguccuaaauaugugcggucugccaagcuccgcaugguuacaggacugagaaacauucccagcauccagucccggggccuguucggggcuauugccggauuuaucgaaggcggguggaccggaaugguggacggcugguacggcuaucaccaccagaaugagcaagggucuggauacgcugccgaucagaaaagcacccagaacgccauuaauggcaucacaaacaaggucaauuccgugaucgagaaaaugaacacgcaguucaccgcuguugggaaggaauuuaacaagcucgagcgcagaauggaaaaucugaacaaaaagguggacgauggauucauugacaucuggacauacaaugcggagcuucugguccuccuggaaaacgagcggacccuugauuuccaugacagcaaugugaaaaaccuguaugaaaaggucaaaucucaacucaagaauaacgccaaggagauuggcaaugggugcuuugaguucuaccacaaauguaacgacgaaugcauggaguccgugaagaauggcacauaugauuaccccaaauauagcgaagagucuaagcugaaccgcgagaaaaucgacgaaguuaagcuggaguccaugggaguguaccagauucucgcuaucuauagcaccgucgccuccucucuggugcuucugguuagccucggcgccaucuccuuuuggaugugcucuaaugggagccugcaguguagaauuugcaucuga

SEQ ID NO: 192169 - RNA, 1701 nt, Artificial Sequence
  derived and/or modified sequence opt5 from hemagglutinin__InfluenzaA__AFM72565
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcauccgcagauccaacaauagcuuuuucucucggcugaacuggcucacacaucugaaguuuaaguauccugcucuuaaugucaccaugcccaacaacgagaaauucgacaagcuguacauuuggggcgugcaccauccugggacggauaaugaccagaucuuuccguaugcccaggcguccggacgcauuacaguuagcaccaaaagaucccaacagacagugauccccaacauuggcucucggccucgcgucagaaauauccccagccggaucuccauuuacuggaccaucgugaagccuggggauauucuccugaucaacagcaccggaaaucugauugcuccccgcggcuacuucaaaaucagaucugggaaguccagcaucaugcggucugacgccccgauuggaaaguguaacagcgaaugcaucacaccuaauggcuccauucccaacgacaaaccuuuucagaaugugaaccgcaucacguauggcgccugucccagauacgucaagcagaauacccucaaacuggcuacagggaugcggaacguucccgagaagcaaacccgcggaauuuucggcgccaucgcgggguuuaucgaaaauggaugggagggcaugguggaugggugguauggauucagacaccagaacucugagggcauuggccaggccgcugaccuuaaaagcacacaagccgcuaucgaucagauuaaugggaagcugaaccggcucaucggaaaaaccaacgaaaaguuccaccagauugagaaggaauuuuccgagguggaaggcagaauccaggaccuggagaaauacgucgaggauacgaagauugaccuuuggagcuauaaugccgaacugcucguggcccuggagaaccaacauacaaucgaucugaccgacucugaaaugaauaaacucuucgagaagaccaaaaagcagcugcgcgaaaacgcugaggauauggggaauggaugcuuuaagaucuaccacaaaugugacaacgcgugcauuggcuccauccggaaugggacauaugaucaugacguuuacagagacgaggcccuuaacaaucgcuuccagauuaagggcguggaacugaaaagcggauacaaggauuggauccucuggauuucuuuugcuaucuccugcuuccugcuuugugucgcccugcucggcuuuaucaugugggccugccagaaagggaacauucgguguaauaucugcauuuga

SEQ ID NO: 192170 - RNA, 1701 nt, Artificial Sequence
  derived and/or modified sequence opt5 from hemagglutinin__InfluenzaA__AFM72576
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcauccgcggcuccaacaauagcuuuuucucuagacugaacuggcucacacaucugaaguuuaaguauccugcucuuaaugucaccaugcccaacaacgagaaauucgacaagcuguacauuuggggagugcaccauccugggacggauaaugaccagaucuuuccguaugcccaggcguccggccggauuacaguuagcaccaaacgcucccaacagacagugauccccaacauugggucuagaccucggguccgcaauauccccagcagaaucuccauuuacuggaccaucgugaagccuggagauauucuccugaucaacagcaccggcaaucugauugcuccccggggguacuucaaaauccgcucuggaaaguccagcaucaugagaucugacgccccgauuggcaaguguaacagcgaaugcaucacaccuaauggcuccauucccaacgacaaaccuuuucagaaugugaaccggaucacguauggggccuguccccgcuacgucaagcagaauacccucaaacuggcuacaggaaugagaaacguucccgagaagcaaacccggggcauuuucggggccaucgcgggauuuaucgaaaauggcugggaggggaugguggauggaugguauggcuuccgccaccagaacucugagggcauugggcaggccgcugaccuuaaaagcacacaagccgcuaucgaucagauuaauggaaagcugaacagacucaucggcaaaaccaacgaaaaguuccaccagauugagaaggaauuuuccgagguggaagggcggauccaggaccuggagaaauacgucgaggauacgaagauugaccuuuggagcuauaaugccgaacugcucguggcccuggagaaccaacauacaaucgaucugaccgacucugaaaugaauaaacucuucgagaagaccaaaaagcagcugagagaaaacgcugaggauaugggaaauggcugcuuuaagaucuaccacaaaugugacaacgcgugcauuggguccauccgcaauggcacauaugaucaugacguuuaccgggacgaggcccuuaacaauagauuccagauuaagggaguggaacugaaaagcggcuacaaggauuggauccucuggauuucuuuugcuaucuccugcuuccugcuuugugucgcccugcucggguuuaucaugugggccugccagaaaggaaacauucgcuguaauaucugcauuuga

SEQ ID NO: 192171 - RNA, 1698 nt, Artificial Sequence
  derived and/or modified sequence opt5 from hemagglutinin__InfluenzaA__AFM72799
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaaagcgccccugcagcugggcaacuguucuguugcuggguggauccucggaaauccugagugcggccugcuuauuagcaaggaauccuggucuuacaucguggagagaccgaaccccgaaaaugggaccuguuauccuggacauuuugccgacuacgaggagcugcgggaacaacucagcuccgucucuagcuucgagcgcuuugaaauuuuccccaaggaguccagcuggccuaaccacacggugaccggcguuucugccuccugcagccauaauggcgagucuuccuuuuauaaaaaccugcuuuggcugacagggaagaauggacucuaccccaaccugagcaaaucuuaugcuaauaacaaggaaaaagaggugcugguccucuggggcgugcaccacccuccgaacaucgggaaucagaugacccuguaccauaaggaaaacgccuacguguccgucguuagcucccacuauucuagaaaguucacacccgagaucgcuaaacggccuaaggugcgcgaucaggaaggaagaauuaauuacuauuggacccuucuggagcccggcgacacgaucauuuuugaggccaacgggaaucucaucgcgccucgguacgccuucgcucugagccgcggauuuggcuccggcauuaucaacagcaaugcccccauggaugaaugugacgcuaaaugccagacaccgcaaggggccauuaacucuucccuuccuuuccagaaugugcaucccgucaccaucggagaguguccuaaguaugugagaagcgcgaaacugcggaugguuacaggccuccgcaacauccccucuauucagagcagagggcuguuuggagccaucgcuggcuucauugaagggggauggaccggcaugguggauggcugguacggguaucaccaccagaaugagcaaggauccggcuacgccgcugaccagaagucuacccagaacgccaucaaugggauuacaaacaaagucaauagcgugaucgaaaagaugaacacgcaguuuaccgccguuggaaaggaguucaacaaacuggagcggcgcauggaaaaucucaacaagaaaguggaugacggcuucaucgaugucuggacauacaaugcugagcugcuugugcugcucgaaaacgagagaacccuggacuuucaugacuccaaugucaagaaccuuuaugaaaaagugaagaaucaacugaagaacaaugcgaaagagauugggaacggcugcuucgaguuuuaccacaaguguaaugaugaaugcauggagagcguuaaaaacggaacauaugacuaccccaaguauucugaagaguccaaacucagccgggagaagaucgauggcgugaagcuggaaucuaugggggucuaccagauucuggccaucuauuccaccguggcuagcucccucguucugcuugugucucugggagccauuagcuucuggaugugcuccaauggcucucuccagugucgcaucugcaucuga

SEQ ID NO: 192172 - RNA, 1698 nt, Artificial Sequence; identical to SEQ ID NO: 192171
  derived and/or modified sequence opt5 from hemagglutinin__InfluenzaA__AFM72810

SEQ ID NO: 192173 - RNA, 1698 nt, Artificial Sequence; identical to SEQ ID NO: 192171
  derived and/or modified sequence opt5 from hemagglutinin__InfluenzaA__AFM72821

SEQ ID NO: 192174 - RNA, 1701 nt, Artificial Sequence
  derived and/or modified sequence opt5 from hemagglutinin__InfluenzaA__AFM72852
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucugacaagggagugacagccgcuuguccucaugccggcgcgaaauccuuuuauaagaaccugaucuggcucguuaaaaagggcaauagcuaccccaaacugucuaaguccuauauuaacgauaaggggaaagaagugcuuguccuguggggaauccaccacccuagcaccuccgccgaccaacagucucucuaccagaaugcugaugccuacguguucgugggcagcuccagauauagcaagacauuuaaaccggagauugcuauccggcccaagguccgcgacagagaggggcggaugaacuacuauuggacccugguugaaccuggagauaaaauuacguucgaggccacaggcaaucugguggugccccgcuacgcguuugccauggaaagaaacgcugggucuggaaucauuaucuccgacaccccuguccaugacugcaacacaaccugucagacccccaagggcgccaucaauacaagccucccguuccaaaacauucacccuaucacgauuggcaaaugccccaaguaugugaagucuaccaaacugcggcuugcuacagggcugcgcaauaucccuagcauucaguccagaggacucuuuggcgccaucgccggguucaucgagggaggcuggaccgggaugguugauggaugguacggcuaucaucaccagaacgaacagggcucuggguacgcugcggaccugaaguccacacaaaaugccauugaugagaucaccaacaaagugaauagcgucauugagaagaugaacacgcaguuuacagcugugggaaaagaguucaaucaccuugagaagcggaucgaaaaccugaauaagaaaguugacgauggcuuccucgacauuuggaccuacaacgccgagcugcuggugcuccuggaaaaugagcgcacccuugauuaucaugacagcaacgucaagaaucuguacgagaaagugagaucucagcucaagaacaacgccaaagaaaucgggaauggauguuuugaguucuaucacaagugcgauaacacauguauggaauccgucaagaauggcaccuacgacuaucccaaauacagcgaggaagcuaagcugaaccgggaggagaucgauggggugaaacuugaaucuacacgcauuuaucagauccuggccauuuacuccacgguugcgagcucccucgugcuggucgugucucugggcgcuaucagcuuuuggaugugcuccaauggaucucuccaaugcagaauuuguaucuga

SEQ ID NO: 192175 - RNA, 1701 nt, Artificial Sequence
  derived and/or modified sequence opt5 from hemagglutinin__InfluenzaA__AFM72862
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaauuccuauauuaacgacaaggggaaggaagugcuuguccuguggggaauccaccacccuagcaccuccgccgaucaacagucucucuaccagaaugcugacgccuacguguucgugggcagcuccagauauagcaaaacauuuaagccggagauugcuauccggcccaaaguccgcgauagagaggggcggaugaacuacuauuggacccugguugaaccuggagacaagauuacguucgaggccacaggcaaccugguggugccccgcuacgcguuugccauggaaagaaaugcugggucuggaaucauuaucuccgauaccccuguccaugacugcaacacaaccugucagacccccaaaggcgccaucaauacaagccucccguuccaaaacauucacccuaucacgauuggcaagugccccaaauaugugaagucuaccaagcugcggcuugcuacagggcugcgcaauaucccuagcauucaguccagaggacucuuuggcgccaucgccggguucaucgagggaggcuggaccgggaugguugacggaugguacggcuaucaucaccagaacgaacagggcucuggguacgcugcggaucugaaaagcacacaaaaugccauugacgagaucaccaacaaggucaauuccgugauugagaaaaugaacacgcaguuuacagcugugggaaaggaguucaaucaccuugagaaacggaucgaaaaccugaauaagaagguugaugacggcuuccucgauauuuggaccuacaacgccgagcugcuggugcuccuggaaaaugagcgcacccuugacuaucaugauagcaacgucaaaaaccuguacgagaaggugagaucucagcucaaaaauaacgccaaggaaaucgggaauggauguuuugaguucuaucacaaaugcgacaacacauguauggaauccgucaagaauggcaccuacgauuaucccaaguacagcgaggaagcuaaacugaaccgggaggagaucgacggggugaaacuugaaucuacacgcauuuaucagauccuggccauuuacuccacgguugcgagcucccucgugcuggucgugucucugggcgcuaucagcuuuuggaugugcuccaauggaucucuccaaugcagaauuuguaucuga

SEQ ID NO: 192176 - RNA, 1701 nt, Artificial Sequence
  derived and/or modified sequence opt5 from hemagglutinin__InfluenzaA__AFM72872
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgagauuugcgacucuccgcaccagauccuugaugggaaaaauuguacgcugaucgacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacccuugaguuuaacaaugaaucuuucaacuggacaggagugacccagaauggcacauccagcgcuugcauucgcagaucuaagaacuccuuuuucagccggcugaauuggcucacccaucugaacuuuaaauauccugcccuuaaugucacgaugcccaacaacgagcaguucgacaagcuguacaucuggggcgugcaccauccugggacagauaaagaccagauuuuuccguaugcgcaagccucuggacgcaucaccguuuccacaaagagaagccagcagaccgcuauucccaauaucggcucccggccucgcgugagaaacauucccucucggaucagcaucuacuggaccauugucaaaccuggggauauccuccugauuaauuccacaggaaaccugaucgcuccccgcggcuacuucaagauuagaagcgggaagucuuccaucaugcggagcgacgccccgaucggaaaauguaauucugagugcauuacgccuaacggcagcauccccaaugacaagccuuuucagaacgugaaucgcauuaccuauggcgccugucccagauacgugaaacaaaacacacucaagcuggcgaccgggaugcggaauguccccgaaaaacagacacgcggaaucuucggcgccauugcuggguuuaucgagaacggaugggaaggcaugguugaugggugguauggauucagacaccaaaauuccgagggccggggccaggccgcugaccuuaagucuacccaggccgccaucgaucagauuaacgggaaacugaauagacucaucggaaagacgaacgagaaguuccaccagauugaaaaagaguuuagcgaaguggagggccgcauccaagaccuggaaaaguacguggaggauacaaaaauugaccuuugguccuauaacgcugagcugcucgucgcgcuggaaaaucagcauaccaucgaucugaccgacagcgagaugaacaaacucuucgaaaagacaaagaagcagcugcgggagaaugccgaagauauggggaacggaugcuuuaaaauuuaccacaagugugacaaugcuugcaucggcucuaucagaaacgggaccuaugaucaugacguguaccgcgacgaggcccuuaauaaccgguuccagauuaaaggcguugagcugaaguccggauacaaagauuggauccucuggauuagcuuugccaucucuugcuuccugcuuuguguggcucugcucggcuuuauuaugugggccugccaaaaggggaauaucagauguaacaucugcauuuga

SEQ ID NO: 192177 - RNA, 1701 nt, Artificial Sequence
  derived and/or modified sequence opt5 from hemagglutinin__InfluenzaA__AFM72883
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugaugggaaaaacuguacccugauugacgcccuccugggagauccccagugcgacggcuuucagaauaagaaaugggaucuguucgucgaaagaucuaaggccuauagcaacuguuacccuuaugacgugcccgauuacgcuucccuccggucucugguugccagcuccgggacgcuugaguuuaauaacgaaucuuucaauuggaccggagugacacagaacggcaccucuuccgcuugcauccgcagaagcaagaauagcuuuuucucccggcugaacuggcucacacaucugaauuuuaaauauccugcccuuaacgucaccaugcccaacaaugagcaguucgacaagcuguacauuuggggcgugcaccauccuguuacggauaaagaccagaucuuucucuaugcgcaagccagcgggcgcauuacagugucuaccaagagaucccagcagacagucaucccgaacauuggaagccggccccgcgugagaaauaucccuacccggaucuccauuuacuggaccaucgugaaacccggcgauauucugcugaucaacucuacagggaaucucauugcuccucgcggauacuucaagaugcagagcggcaaguccagcaucaugagaucugacgcccccaucgggaaauguaacuccgagugcauuacgccgaauggaagcaucccuaacgacaagcccuuucaaaaugucaaccggauuaccuauggcgcuuguccucgcuacguuaaacagaauacacugaaacuugccaccggcaugagaaacgugcccgaaaaacagacacgggggaucuucggagcgauugccggcuuuaucgagaaugggugggaaggaaugguggauggcugguauggguuccgccaccaaaacucugagggaagaggccaggcugccgaccucaagagcacccaggcugccaucgaucagauuaauggcaaacugaaccggcugaucgggaagacgaacgagaaguuccaccaaauugaaaaagaguuuuccgaagucgagggaagaauccaggaccuugaaaaguacguggaggauacaaaaauugaccuguggucuuauaaugccgagcuccugguugcucuggaaaaccagcauaccaucgaucucaccgacagcgagaugaauaagcuguucgaaaagacaaagaagcagcuucgcgagaacgcggaagauaugggcaaugggugcuuuaaaauuuaccacaagugugacaacgccugcaucggauccauccggaauggcaccuaugaucauaacguguacagagacgaggcucugaauaaccgcuuccaaauuaaaggggucgagcucaagagcggcuacaaagacuggauccuguggauuucuuuugccaucuccugcuuccuucuguguguggcccuccugggauuuauuaugugggcuugccagaagggcaauauccgguguaacaucugcauuuga

SEQ ID NO: 192178 - RNA, 1701 nt, Artificial Sequence
  derived and/or modified sequence opt5 from hemagglutinin__InfluenzaA__AFM72894
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcgacuccccgcaccagauccuugaugggaaaaacuguacccugauugacgcccuccugggagauccccagugcgacggcuuucagaauaagaaaugggaucuguucgucgaaagaucuaaggccuauagcaacuguuacccuuaugacgugcccgauuacgcuucccuccggucucugguugccagcuccgggacgcuugaguuuaauaacgaaucuuucaauuggaccggagugacacagaacggcaccucuuccgcuugcauccgcagaagcaagaauagcuuuuucucccggcugaacuggcucacacagcugaauuuuaaauauccugcccuuaacgucaccaugcccaacaaugagcaguucgacaagcuguacauuuggggcgugcaucacccuguuacggauaaagaccaaaucuuucucuaugcgcaggccagcgggcgcauuacagugucuaccaagagaucccagcagacagucaucccgaacauuggaagccggccccgcgugagaaauaucccuucccggaucucuauuuacuggaccaucgugaaacccggcgauauucugcugaucaacagcaccgggaaucucauugcuccucgcggauacuucaagaugcaauccggcaagagcucuaucaugagauccgacgcccccaucgggaaauguaacagcgagugcauuacaccgaauggaucuaucccuaacgacaagcccuuucagaaugucaaccggauuacguauggcgcuuguccucgcuacguuaaacagaauacccugaaacuugccacaggcaugagaaacgugcccgaaaaacaaacccgggggaucuucggagcgauugccggcuuuaucgagaaugggugggaaggaaugguggauggcugguauggguuccgccaucagaacagcgagggaagaggccaggcugccgaccugaaguccacacaggcugccaucgaucaaauuaauggcaaacucaaccggcugaucgggaagaccaacgagaaguuccaccagauugaaaaagaguuuucugaagucgagggaagaauccaggaccuugaaaaguacguggaggauacgaaaauugaccuguggagcuauaaugccgagcuccugguugcucuggaaaaccagcacacaaucgaucucaccgacuccgagaugaauaagcuguucgaaaagaccaagaagcaacuucgcgagaacgcggaagauaugggcaaugggugcuuuaaaauuuaccauaagugugacaacgccugcaucggaagcauccggaauggcacauaugaucacaacguguacagagacgaggcucugaauaaccgcuuccagauuaaaggggucgagcucaagucuggcuacaaagacuggauccuguggauuuccuuugccaucagcugcuuccuucuguguguggcccuccugggauuuauuaugugggcuugccagaagggcaauauccgguguaacaucugcauuuga

SEQ ID NO: 192179 - RNA, 1701 nt, Artificial Sequence
  derived and/or modified sequence opt5 from hemagglutinin__InfluenzaA__AFM72916
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggaugggaaaaauuguacccuuaucgacgcccugcucggagauccccagugcgacggcuuucaaaacaagaaaugggaucuguucgucgaaagaagcaaggccuauuccaauuguuacccuuaugacgugcccgauuacgcuucucugcggagccucguugccuccagcgggacgcuggaguuuaacaaugaaucuuucaacuggaccggagugacacagaauggcaccuccagcgcuugcauucgcagaucuaagaacuccuuuuucagccggcuuaauuggcugacacaucucaacuuuaaauauccugcccugaaugucaccaugcccaacaacgagcaguucgacaaacuuuacaucuggggcgugcaccauccugggacggauaaggaccagauuuuuccguaugcgcaagccucuggacgcaucacaguuuccaccaagagaagccagcagacagcuauucccaauaucggcucccggccucgcgugagaaacauccccucucggauuagcaucuacuggaccauugucaaaccuggggauauccugcucauuaauuccaccggaaaccugaucgcuccccgcggcuacuucaagaucagaagcgggaagucuuccauuaugcggagcgacgcuccgaucggaaaauguaauucuggcugcauuacaccuaacggcagcauccccaaugacaagccuuuucagaacgugaaucgcauuacguauggggccugucccagauacgugaaacaaaacacccugaagcucgcgacaggaaugcggaauguccccgagaaacagacccgcggcaucuucggggccaucgcuggauuuauugaaaacggcugggaggggaugguugauggaugguauggcuucagacaccaaaauuccgaaggccgggggcaggccgcugaccugaagucuacacaggccgccaucgaucagauuaacggaaaacuuaauagacugaucggcaagaccaacgagaaguuccaccagauugagaaagaauuuagcgagguggaagggcgcauccaagaccucgagaaguacguggaagauacgaaaauugaccugugguccuauaacgcugagcuucuggucgcgcucgagaaucagcauacaaucgaucugaccgacagcgaaaugaacaagcuguucgagaaaaccaagaagcagcuccgggaaaaugccgaggauaugggaaacggcugcuuuaaaaucuaccacaagugugacaaugcuugcauugggucuaucagaaacggcacauaugaucaugacguguaccgcgacgaagcccugaauaaccgguuccagauuaaaggaguugagcuuaaguccggcuacaaagauugguuucuguggaucagcuucgccauuucuugcuuucuccuguguguggcccuucugggguucaucaugugggccugccaaaagggaaauaucagauguaacauuugcaucuga

SEQ ID NO: 192180 - RNA, 1701 nt, Artificial Sequence
  derived and/or modified sequence opt5 from hemagglutinin__InfluenzaA__AFM72927
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagacaucucucuaugcgcaagccuccggacgcaucaccguuagcacaaagagaucccagcagaccgugauuccgaacaucggcucucggccccgcgucagaaauauuccuagccggaucuccaucuacuggaccauugugaaacccggggauauccugcugauuaacagcaucggaaaucucauugcuccucgcggcuacuuuaagaucagaucugggaaauccagcaucaugcggucugacgcccccauuggaaaguguaacagcgaaugcaucacaccgaauggcuccauuccuaacgacaagcccuuccagaaugugaaccgcaucacguauggcgcuuguccuagauacgucaaacaaaauacccugaagcuggccacagggaugcggaacguucccgagaaacagacccgcggaauuuuuggcgcgaucgccggguucaucgaaaauggaugggagggcaugguggaugggugguauggauuuagacaccagaacucugagggccggggccaagcugccgaccuuaagagcacacaggcugccauugaucagaucaaugggaaacucaacagacugauuggaaagaccaacgaaaaauuccaccagaucgagaaggaguucuccgaaguggaaggccgcauucaagaccuugagaaguacgucgaggauacgaaaaucgaccuguggagcuauaaugccgaacuccugguggcucuggagaaccagcauacaauugaucucaccgacucugaaaugaauaagcuguuugagaaaaccaagaaacagcuucgggaaaacgcggaggauauggggaauggaugcuucaagaucuaccacaagugugacaacgccugcaucggcuccauuagaaaugggacauaugaucauaacguuuaccgcgacgaggcucugaauaaccgguuucagaucaaaggcguggaacucaagagcggauacaaagacuggauucuguggaucucuuucgccauuuccugcuuucuucugugugucgcccuccugggcuucaucaugugggcuugccaaaaggggaauaucagauguaacauuugcaucuga

SEQ ID NO: 192181 - RNA, 1701 nt, Artificial Sequence
  derived and/or modified sequence opt5 from hemagglutinin__InfluenzaA__AFM72938
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagacaucucucuaugcgcaagccuccggacgcaucaccguuagcacaaagagaucccagcagaccgugauuccgaacaucggcucucggccccgcgucagaaauaacccuagccggauuuccaucuacuggaccaucgugaaacccggggauauucugcugaucaauagcauuggaaaccucaucgcuccucgcggcuacuuuaagauuagaucugggaaauccagcaucaugcggucugacgcccccaucggaaaguguaauagcgaaugcauuacaccgaacggcuccaucccuaaugacaagcccuuccagaacgugaaucgcauuacguauggcgcuuguccuagauacgucaaacaaaacacccugaagcuggccacagggaugcggaauguucccgagaaacagacccgcggaaucuuuggcgcgauugccggguucaucgaaaacggaugggagggcaugguggaugggugguauggauuuagacaccaaaauucugagggccggggccaggcugccgaccuuaagagcacacaggcugccaucgaucagauuaacgggaaacucaacagacugaucggaaagaccaaugaaaaauuccaccagauugagaaggaguucuccgaaguggaaggccgcauccaagaccuugagaaguacgucgaggauacgaaaauugaccuguggagcuauaacgccgaacuccugguggcucuggagaaucagcauacaaucgaucucaccgacucugaaaugaacaagcuguuugagaaaaccaagaaacagcuucgggaaaaugcggaggauauggggaacggaugcuucaagauuuaccacaagugugacaaugccugcaucggcuccaucagaaacgggacauaugaucauaauguuuaccgcgacgaggcucugaacaaucgguuucagauuaaaggcguggaacucaagagcggauacaaagacuggauccuguggauuucuuucgccaucuccugcuuucuucugugugucgcccuccugggcuucauuaugugggcuugccaaaaggggaacaucagauguaauaucugcauuuga

SEQ ID NO: 192182 - RNA, 1701 nt, Artificial Sequence
  derived and/or modified sequence opt5 from hemagglutinin__InfluenzaA__AFM72949
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacagcugaaguuuaaguauccugcccuuaaugucaccaugcccaacaacgagcaguucgacaaacuguacauuuggggcgugcaucacccugggacggauaaugaccaaacaucucucuaugcgcaggccuccggacgcaucaccguuagcacaaagagaucccagcagaccgugauuccgaacaucggcucucggccccgcgucagaaauaacccuagccggauuuccaucuacuggaccaucgugaaacccggggauauucugcugaucaauagcauuggaaaccucaucgcuccucgcggcuacuuuaagauuagaucugggaaauccagcaucaugcggucugacgcccccaucggaaaguguaauagcgaaugcauuacaccgaacggcuccaucccuaaugacaagcccuuccaaaacgugaaucgcauuacguauggcgcuuguccuagauacgucaaacagaacacccugaagcuggccacagggaugcggaauguucccgagaaacagacccgcggaaucuuuggcgcgauugccggguucaucgaaaacggaugggagggcaugguggaugggugguauggauuuagacaucaaaauucugagggccggggccaggcugccgaccuuaagagcacacaggcugccaucgaucagauuaacgggaaacucaacagacugaucggaaagaccaaugaaaaauuccaccaaauugagaaggaguucuccgaaguggaaggccgcauccaggaccuugagaaguacgucgaggauacgaaaauugaccuguggagcuauaacgccgaacuccugguggcucuggagaaucagcacacaaucgaucucaccgacucugaaaugaacaagcuguuugagaaaaccaagaaacagcuucgggaaaaugcggaggauauggggaacggaugcuucaagauuuaccauaagugugacaaugccugcaucggcuccaucagaaacgggacauaugaucacaauguuuaccgcgacgaggcucugaacaaucgguuucaaauuaaaggcguggaacucaagagcggauacaaagacuggauccuguggauuucuuucgccaucuccugcuuucuucugugugucgcccuccugggcuucauuaugugggcuugccagaaggggaacaucagauguaauaucugcauuuga

SEQ ID NO: 192183 - RNA, 1701 nt, Artificial Sequence
  derived and/or modified sequence opt5 from hemagglutinin__InfluenzaA__AFM72960
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaaguggaccggagugacacagaacggcaccuccagcgcuugcauccgcagaucuaauaacuccuuuuucagccggcugaauuggcucacacaucugaaguuuaaauauccugcccuuaacgucaccaugcccaauaacgagcaguucgacaagcuguacauuuggggcgugcaccauccugggacggauaacgaccagacaucucucuaugcgcaagccuccggacgcaucaccguuagcacaaaaagaucccagcagaccgugauuccgaauaucggcucucggccccgcgucagaaacauuccuagccggaucuccaucuacuggaccauugugaagcccggggauauccugcugauuaauagcaucggaaaccucauugcuccucgcggcuacuuuaaaaucagaucugggaaguccagcaucaugcggucugacgcccccauuggaaaguguaauagcgaaugcaucacaccgaacggcuccauuccuaaugacaaacccuuccagaacgugaaucgcaucacguauggcgcuuguccuagauacgucaagcaaaacacccugaaacuugccacagggaugcggaauguucccgagaagcagacccgcggaauuuuuggcgcgaucgccggguucaucgaaaacggaugggagggcaugguggaugggugguauggauuuagacaccaaaauucugagggccggggccaggcugccgaccugaaaagcacacaggcugccauugaucagaucaacgggaagcucaauagacugauuggaaaaaccaacgaaaaguuccaccagaucgagaaggaguucuccgaaguggaaggccgcauucaagaccuugagaaauacgucgaggauacgaagaucgaccuguggagcuauaacgccgaacuccugguggcucuggagaaucagcauacaauugaucucaccgacucugaaaugaacaaacuguuugagaagaccaaaaagcagcuucgggaaaaugcggaggauauggggaacggaugcuucaagaucuaccacaaaugugacaaugccugcaucggcuccauuagaaacgggacauaugaucauaauguuuaccgcgacgaggcucugaacaaucgguuucagaucaagggcguggaacucaaaagcggauacaaggacuggauucuguggaucucuuucgccauuuccugcuuucuucugugugucgcccuccugggcuucaucaugugggcuugccaaaaagggaacaucagauguaauauuugcaucuga

SEQ ID NO: 192184 - RNA, 1701 nt, Artificial Sequence
  derived and/or modified sequence opt5 from hemagglutinin__InfluenzaA__AFM72971
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaaguggaccggagugacacagaacggcaccuccagcgcuugcauccgcagaucuaauaacuccuuuuucagccggcugaauuggcucacacagcugaacuuuaaguauccugcccuuaaugucaccaugcccaacaacgagcaguucgacaaacuguacauuuggggcgugcaucacccugggacggauaaugaccaaacaucucucuaugcgcaggccuccggacgcaucaccguuagcacaaagagaucccagcagaccgugauuccgaacaucggcucucggccccgcgucagaaauauuccuagccggaucuccaucuacuggaccauugugaaacccggggauauccugcugauuaacagcaucggaaaucucauugcuccucgcggcuacuuuaagaucagaucugggaaauccagcaucaugcggucugacgcccccauuggaaaguguaacagcgaaugcaucacaccgaauggcuccauuccuaacgacaagcccuuccaaaaugugaaccgcaucacguauggcgcuuguccuagauacgucaaacagaauacccugaagcuggccacagggaugcggaacguucccgagaaacagacccgcggaauuuuuggcgcgaucgccggguucaucgaaaauggaugggagggcaugguggaugggugguauggauuuagacaucaaaacucugagggccggggccaggcugccgaccuuaagagcacacaggcugccauugaucagaucaaugggaaacucaacagacugauuggaaagaccaacgaaaaauuccaccaaaucgagaaggaguucuccgaaguggaaggccgcauucaggaccuugagaaguacgucgaggauacgaaaaucgaccuguggagcuauaaugccgaacuccugguggcucuggagaaccagcacacaauugaucucaccgacucugaaaugaauaagcuguuugagaaaaccaagaaacagcuucgggaaaacgcggaggauauggggaauggaugcuucaagaucuaccauaagugugacaacgccugcaucggcuccauuagaaaugggacauaugaucacaacguuuaccgcgacgaggcucugaauaaccgguuucaaaucaaaggcguggaacucaagagcggauacaaagacuggauucuguggaucucuuucgccauuuccugcuuucuucugugugucgcccuccugggcuucaucaugugggcuugccagaaggggaauaucagauguaacauuugcaucuga

SEQ ID NO: 192185 - RNA, 1701 nt, Artificial Sequence
  derived and/or modified sequence opt5 from hemagglutinin__InfluenzaA__AFM72982
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacucugaguccuucaauuggaccggagugacacagaacggcaccagcucugcuugcauccgcagauccaauaacagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuuccguaugcgcaagccuccggacgcauuacaguuagcaccaagagaucccagcaggcugugauccccaauauuggcucucggccucgcgucagaaacauccccagccggaucuccauuuacuggacaaucgugaaaccuggggauauucuccugaucaauagcaccggaaaccugauugcuccccgcggcuacuucaagaucagaucugggaaauccagcaucaugcggucugacgccccgauuggaaaguguaauagcgaaugcaucaccccuaacggcuccauucccaaugacaagccuuuucagaacgugaaucgcaucacauauggcgccugucccagauacauuaaacaaucuacgcucaagcuggcgaccgggaugcggaacguccccgagaaacagacacgcggaaucuucggcgccaucgcuggguuuauugaaaauggaugggagggcaugguugaugggugguauggauucagacaccagaacagcgagggccggggccaagccgcugaccuuaaguccacccaggccgccaucgaucagauuaaugggaaacugaacagacucaucggaaagacaaaugaaaaauuccaccagauugagaaggaauuuagcgagguggaaggccgcauccaagaccuggagaaguacguggaggauaccaaaauugaccuuuggucuuauaacgcugaacugcucgucgcgcuggagaaccagcauacgaucgaucugacagacuccgaaaugaauaaacucuucgagaagaccaagaaacagcugcgggaaaacgccgaggauauggggaauggaugcuuuaagaucuaccacaagugugacaacgcuugcauuggcagcaucagaaaugggaccuaugaucaugacguguaccgcgacgaggcccuuaacaaucgguuccagauuaaaggcguugaacugaagucuggauacaaagauuggauccucuggauuucccuggccaucagcugcuuucuucuguguguggcucuccugggcuucaucaugugggccugccaaaaggggaacauuagauguaauaucugcauuuga

SEQ ID NO: 192186 - RNA, 1701 nt, Artificial Sequence
  derived and/or modified sequence opt5 from hemagglutinin__InfluenzaA__AFM72993
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccagaauggcacauccagcgccugcaucagacggucuaacaauuccuuuuucagccgccugaacuggcucacccaucugaauuuuaaauauccugcgcuuaacgucacaaugcccaacaaugagcaguucgacaagcuguacauuuggggcgugcuccacccugggaccuauaaggaucagaucuuucuguacgcccaggcuucuggaagaauuacgguuuccacaaaacggagccagcaggccgugaucccgaacauuggcucccgccccagaguccggaauaucccuucucgcaucagcauuuacuggaccaucgugaagcccggggacauucugcucaucaacuccacaggaaaucugauugcuccuagaggcuauuucaaaauccggagcgggaagucuuccaucaugcgcagcgaugcccccauuggaaaauguaacucugaaugcaucaccccgaauggcagcauuccuaacgacaagcccuuucagaaugugaacagaaucaccuacggcgcguguccucgguaugucaagcaauccacacuuaaacuggccacggggaugcgcaauguucccgagaagcagaccagaggaauuuucggcgcuaucgccggguuuaucgaaaacggaugggagggcaugguggacgggugguacggauuccggcaucaaaauucugagggcagaggccaagcugccgaucucaaaagcacacaggccgcuauugaccagaucaacgggaagcugaaucgccuuauuggaaaaaccaacgaaaaguuccaccagaucgagaaagaauuuuccgagguggaaggccggauucaagaucuggagaaguaugucgaggacacaaagaucgaucucuggagcuacaacgcggaacugcugguggcccucgagaaucagcacaccauugaccugacggauucugaaaugaacaaacuuuucgagaagaccaaaaagcagcugagagaaaaugcugaggacauggggaacggaugcuuuaaaaucuaucauaagugugauaaugccugcaucggcuccauucgcaacgggacauacgaccacgauguuuaccgggacgaggcccucaauaacagauuccagaucaagggcguggaacugaaaagcggauauaaggacuggauucuuuggaucucuuuugcuauuuccugcuuccugcucugugucgcccugcugggcuuuaucaugugggcgugccaaaaagggaauauccgcuguaacauuugcaucuga

SEQ ID NO: 192187 - RNA, 1701 nt, Artificial Sequence
  derived and/or modified sequence opt5 from hemagglutinin__InfluenzaA__AFM73004
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccagauccuugauggggaaaauuguacacugauugacgcccuccugggagauccccagugcgacggcuuucaaaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccagaauggcacauccagcgccugcaucagacggucuaacaauuccuuuuucagccgccugaacuggcucacccaucugaauuuuaaauauccugcgcuuaacgucacaaugcccaacaaugagcaguucgacaagcuguacauuuggggcgugcuccacccugggaccuauaaggaucagaucuuucuguacgcccaggcuucuggaagaguuacgguguccacaaaacggagccagcaggccgucauuccgaacaucggcucccgccccagagugcggaauauuccuucucgcaucagcaucuacuggaccauugugaagcccggggacauccugcucauuaacuccacaggaaaucugaucgcuccuagaggcuauuucaaaauucggagcgggaagucuuccaucaugcgcagcgaugcccccaucggaaaauguaacucugaaugcauuaccccgaauggcagcaucccuaacgacaagcccuuucagaaugucaacagaauuaccuacggcgcguguccucgguauguuaagcaauccacacuuaaacuggccacggggaugcgcaaugugcccgagaagcagaccagaggaaucuucggcgcuauugccggguuuaucgaaaacggaugggagggcaugguggacgggugguacggauuccggcaucaaaauucugagggcagaggccaagcugccgaucucaaaagcacacaggccgcuaucgaccagauuaacgggaagcugaaucgccuuaucggaaaaaccaacgaaaaguuccaccagauugagaaagaauuuuccgaggucgaaggccggauccaagaucuggagaaguauguggaggacacaaagauugaucucuggagcuacaacgcggaacugcugguugcccucgagaaucagcacaccaucgaccugacggauucugaaaugaacaaacuuuucgagaagaccaaaaagcagcugagagaaaaugcugaggacauggggaacggaugcuuuaaaauuuaucauaagugugauaaugccugcaucggcuccauccgcaacgggacauacgaccacgauguguaccgggacgaggcccucaauaacagauuccagauuaagggcgucgaacugaaaagcggauauaaggacuggauccuuuggauuucuuuugcuaucuccugcuucuuucuguguguggcccuccugggcuucauuaugugggcgugccaaaaagggaauauccgcuguaacaucugcauuuga

SEQ ID NO: 192188 - RNA, 1701 nt, Artificial Sequence
  derived and/or modified sequence opt5 from hemagglutinin__InfluenzaA__AFM73015
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgauagagagggacggaugaauuacuauuggacacugguugaacccggcgacaagauuaccuucgaggcuacagggaaccugguggugccucgcuacgccuuugcgauggaaagaaacgccggauccggcaucauuaucagcgauacccccguccaugacugcaauaccacaugucagacgccuaaaggcgcuaucaacaccucucuccccuuccaaaauauucacccgaucacaauugggaagugcccuaaguaugugaaauccaccaagcugcggcuugccacaggacugcgcaacguucccagcauccagucuagaggccucuuuggggcuauugccggauucaucgagggcggguggaccggaaugguggacggcugguacggcuaucaucaccagaaugaacaggggagcggauacgccgcugaucugaaauccacgcaaaacgcgaucgacaagauuacaaauaaagucaacucugugaucgagaagaugaauacccaguuuaccgccguuggcaaggaguucaaccaccuugaaaaacggauugagaaucugaacaagaaaguggaugacggguuccucgauaucuggacauacaaugcugaacugcugguccuccuggagaacgaacgcacccuugacuaucaugauagcaaugugaagaaccuguacgagaaagucagaaaccagcucaagaauaacgccaaggagauuggaaauggcuguuuugaguucuaucacaaaugcgacaacacauguauggaguccgugaagaaugggacguacgauuauccuaaauacagcgaagaggccaagcugaaccgggaagagaucgacggcguuaaacuugagucuacccgcaucuaucagauucuggcuaucuacuccacaguggccagcucucucguccuggugguuucccugggagcgauuagcuuuuggaugugcuccaauggcucucuccaaugcagaaucuguauuuga

SEQ ID NO: 192189 - RNA, 1701 nt, Artificial Sequence
  derived and/or modified sequence opt5 from hemagglutinin__InfluenzaA__AFM73025
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagaugaccaacagucccucuaccagaacgccgauaccuacguguucguggggacgucuagauauagcaagaaauuuaagccugagauugcuauccggccgaaaguccgcgacagagagggacggaugaauuacuauuggacacugguugaacccggcgauaagauuaccuucgaggccacagggaaccugguggugccucgcuacgcuuuugccauggaaagaaacgcgggauccggcaucauuaucagcgacacccccguccaugacugcaauaccacaugucagacgccuaaaggcgccaucaacaccucucuccccuuccaaaauauucacccgaucacaauugggaagugcccuaaguaugugaaauccaccaagcugcggcuugcuacaggacugcgcaacguucccagcauccagucuagaggccucuuuggggccauugcuggauucaucgagggcggguggaccggaaugguggauggcugguacggcuaucaucaccagaaugaacaggggagcggauacgccgccgaccugaaauccacgcaaaacgcuaucgauaagauuacaaauaaagucaacucugugaucgagaagaugaauacccaguuuaccgcgguuggcaaggaguucaaccaccuugaaaaacggauugagaaucugaacaagaaaguggacgauggguuccucgacaucuggacauacaaugccgaacugcugguccuccuggagaacgaacgcacccuugauuaucaugacagcaaugugaagaaccuguacgagaaagucagaaaccagcucaagaauaacgcuaaggagauuggaaauggcuguuuugaguucuaucacaaaugcgauaacacauguauggaguccgugaagaaugggacguacgacuauccuaaauacagcgaagaggccaagcugaaccgggaagagaucgauggcguuaaacuugagucuacccgcaucuaucagauucuggccaucuacuccacaguggcuagcucucucguccuggugguuucccugggagccauuagcuuuuggaugugcuccaauggcucucuccaaugcagaaucuguauuuga

SEQ ID NO: 192190 - RNA, 1701 nt, Artificial Sequence; identical to SEQ ID NO: 192189
  derived and/or modified sequence opt5 from hemagglutinin__InfluenzaA__AFM73035

SEQ ID NO: 192191 - RNA, 1701 nt, Artificial Sequence
  derived and/or modified sequence opt5 from hemagglutinin__InfluenzaA__AFM73045
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaaacacaaugggaagcuguguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgaauccaacaagggagugacagccgcuuguccccaugccggcgccaagagcuuuuauaaaaaucugaucuggcucguuaagaaaggcaacucuuacccuaagcuguccaaaagcuauauuaaugauaaggggaaggaggugcuuguccuguggggaauccaccaccccuccaccucugccgaccaacagagccucuaccagaacgcugaugccuacguguucgugggcacaucccgguauagcaaaaaguuuaaaccugagauugcuauccgcccgaaggucagagaccaggaagggcggaugaauuacuauuggacccugguugagcccggagauaaaauuacguucgaagccacaggcaaccugguggugccucgcuacgcguuugccauggagagaaacgcugggucuggaaucauuaucuccgacacccccguccaugauugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgaaggaggcuggaccgggaugguggacggaugguacggcuaucaucaccagaaugagcaaggcucuggguacgcugcggaccuuaagagcacacagaacgccaucgaugagauuaccaauaaagucaacuccgugaucgaaaagaugaauacgcaguuuacagcuguuggaaaagaguucaaccaccuugaaaagcggauugagaaucugaacaagaaaguggacgauggcuuccucgacaucuggaccuacaaugccgaacugcugguccuccuggagaacgagcgcacccuugauuaucaugacagcaaugugaagaaccuguacgaaaaagucagaucucagcucaagaacaaugccaaagagauugggaacggauguuuugaguucuaucacaagugcgauaauacauguauggaguccgugaagaacggcaccuacgacuauccuaaauacagcgaagaggcuaagcugaaucgggaggaaaucgaugggguuaaacuugagucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 192192 - RNA, 1701 nt, Artificial Sequence
  derived and/or modified sequence opt5 from hemagglutinin__InfluenzaA__AFM73055
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaaacuuuguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguugaaaagggcaacucuuacccuaaacuguccaagagcuauauuaaugacaaagggaaggaggugcuuguccuguggggaauccaccaccccuccaccucugccgaucaacagagccucuaccagaacgcugacgccuacguguucgugggcacaucccgguauagcaagaaauuuaagccugagauugcuauccgcccgaaagucagagaucgggaagggcgcaugaauuacuauuggacccugguugagcccggagacaagauuacguucgaagccacaggcaaccugguggugccuagauacgcguuugccauggagcggaacgcugggucuggaaucauuaucuccgauacccccguccaugacugcaauacaaccugucagaccccuaaaggcgccaucaacacaagccuccccuuccaaaauauucacccgaucacgauuggcaagugcccuaaauaugugaagucuaccaagcugcgccuugcuacagggcugagaaacguucccagcauccagucccggggacucuuuggcgccauugccggguucaucgaaggaggcuggaccgggaugguggacggaugguacggcuaucaucaccagaaugagcagggcucuggguacgcugcggaucugaaaagcacacaaaacgccaucgacgagauuaccaauaaggucaacuccgugaucgaaaagaugaauacgcaguuuacagcuguuggaaaggaguucaaccaccuugaaaaacgcauugagaaucugaacaagaagguggaugacggcuuccucgauaucuggaccuacaaugccgaacugcugguccuccuggagaacgagagaacccuugacuaucaugauagcaaugugaaaaaccuguacgaaaagguccggucucagcucaaaaacaaugccaaggagauugggaacggauguuuugaguucuaucacaaaugcgacaauacauguauggaguccgugaagaacggcaccuacgauuauccuaaguacagcgaagaggcuaaacugaaucgcgaggaaaucgacgggguuaaacuugagucuacaagaaucuaucagauucuggccaucuacuccacgguggcgagcucccucguccuggugguuucucugggcgcuauuagcuuuuggaugugcuccaacggaucucuccaaugccggaucuguauuuga

SEQ ID NO: 192193 - RNA, 1701 nt, Artificial Sequence
  derived and/or modified sequence opt5 from hemagglutinin__InfluenzaA__AFM73065
augaaggccauccuggugguccuccuguacaccuucgcuacagccaacgcggacacgcuuugcauuggcuaucacgcuaauaacagcaccgauacaguugacaccgugcuggagagaaaugugacagucacccauuccgugaaccuccuggaagauaagcacaaugggaaacuuuguaaacugcggggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaaaaccagcucuuggccuaaucacgauuccaacaagggagugacagccgcuuguccccaugccggcgccaagagcuuuuauaaaaaucugaucuggcucguuaaggaaggcaacucuuacccuaaacuguccaagagcuauauuaaugacaaagggaaggaggugcuuguccuguggggaauccaccaccccuccaccucugccgaucaacagagccucuaccagaacgcugacgccuacguguucgugggcacaucccgguauagcaagaaauuuaagccugagauugcuauccgcccgaaagucagagaucgggaagggcgcaugaauuacuauuggacccugguugagcccggagacaagauuacguucgaagccacaggcaaccugguggugccuagauacgcguuugccauggagcggaacgcugggucuggaaucauuaucuccgauacccccguccaugacugcaauacaaccugucagaccccuaaaggcgccaucaacacaagccuccccuuccaaaauauucacccgaucacgauuggcaagugcccuaaauaugugaagucuaccaagcugcgccuugcuacagggcugagaaacguucccagcauccagucccggggacucuuuggcgccauugccggguucaucgaaggaggcuggaccgggaugguggacggaugguacggcuaucaucaccagaaugagcagggcucuggguacgcugcggaucugaaaagcacacaaaacgccaucgacgagauuaccaauaaggucaacuccgugaucgaaaagaugaauacgcaguuuacagcuguuggaaaggaguucaaccaccuugaaaaacgcauugagaaucugaacaagaagguggaugacggcuuccucgauaucuggaccuacaaugccgaacugcugguccuccuggagaacgagagaacccuugacuaucaugauagcaaugugaaaaaccuguacgaaaagguccggucucagcucaaaaacaaugccaaggagauugggaacggauguuuugaguucuaucacaaaugcgacaauacauguauggaguccgugaagaacggcaccuacgauuauccuaaguacagcgaagaggcuaaacugaaucgcgaggaaaucgacgggguuaaacuugagucuacaagaaucuaucagauucuggccaucuacuccacgguggcgagcucccucguccuggugguuucucugggcgcuauuagcuuuuggaugugcuccaacggaucucuccaaugccggaucuguauuuga

SEQ ID NO: 192194 - RNA, 1701 nt, Artificial Sequence; identical to SEQ ID NO: 183939
  derived and/or modified sequence opt5 from hemagglutinin__InfluenzaA__AFM73477

SEQ ID NO: 192195 - RNA, 1707 nt, Artificial Sequence
  derived and/or modified sequence opt5 from hemagglutinin__InfluenzaA__AFM78567
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucuggaccauucucaagcccaacgacgccaucaauuuugagucuaacggaaauuucauugcgccugaauacgccuauaaaaucgucaagaaaggcgauagcgcuaucaugaaguccgagcuggaauacgggaacugcaauacgaaaugucaaacacccaugggagccauuaacagcucuaugccguuucauaauauccacccucuuaccauuggcgagugccccaaguauguuaaguccaaccggcuggugcucgcuacagggcugcgcaauagcccucagagagagucucggcgcaaaaagagaggacuuuucggcgccaucgcgggcuuuauugaagggggauggcagggcaugguggacgggugguacggauaucaucacagcaacgagcagggcuccggguacgccgcugacaaagaaucuacccaaaaggccaucgauggagucaccaauaaagugaacagcaucauugacaagaugaauacacaguucgaggcuguuggccgggaauuuaacaaccuggagcgcagaaucgagaaucucaacaagaaaauggaagauggcuuccuggacguguggacguauaaugccgagcugcucguccugauggaaaacgagcggacccuugauuuccacgacuccaaugugaagaaccuguacgauaaaguucgccuccagcugagagacaaugccaaggaacuugggaacggauguuuugaguucuaccauaaaugcgauaaugaguguauggaaagcauucggaacggcacauauaauuacccccaauauucugaggaagcuagacugaagcgcgaggagaucuccggggugaagcucgaaagcauuggaaccuaccagauccugucuauuuauuccacagucgcgagcucccuggcccucgcuaucaugauggccggccugucucuuuggaugugcagcaacgggucccugcagugccggaucuguauuuga

SEQ ID NO: 192196 - RNA, 1701 nt, Artificial Sequence
  derived and/or modified sequence opt5 from hemagglutinin__InfluenzaA__AFM78646
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagggccucuaccagaacgcugacgccuacguguucguggggacaucuagauauagcaagaaauuuaagccggagauugcuauccggcccaaaguccgcgaucaggagggaagaaugaauuacuauuggacccugguugaaccuggcgacaagauuacguucgaggccacagggaaccugguggugccccgguacgcguuugccauggaacgcaacgcuggauccggcaucauuaucagcgauaccccuguccaugacugcaauacaaccugucaaacccccaaaggcgccaucaacacaucucucccguuccagaauauucacccuaucacgauugggaagugccccaaguaugugaaauccaccaagcugagacuugcuacaggacugcggaacguuccuagcauccagucucgcggccucuuuggggccauugccggauucaucgagggcggguggaccggaaugguggacggcugguacggcuaucaucaccagaaugaacaagggagcggauacgcugcggaucugaaauccacacagaacgccaucgacgagauuaccaauaaggucaacucugugaucgagaaaaugaauacgcaguuuacagcuguuggcaaggaguucaaccaccuugagaagagaauugaaaaucugaacaaaaagguggaugacggguuccucgauaucuggaccuacaaugccgagcugcugguccuccuggaaaacgagcggacccuugacuaucaugauagcaaugugaaaaaccuguacgagaagguccgcucccagcucaaaaacaaugccaaggaaauuggaaacggcuguuuugaguucuaucacaagugcgacaauacauguauggaaagcgugaaaaacgggaccuacgauuaucccaaguacucugaggaagcuaaacugaauagagaggagaucgacggcguuaaacuugaauccacacggaucuaucaaauucuggccaucuacagcacgguggcgucuucccucguccuggugguuagccugggagcuauuuccuuuuggaugugcucuaacggcagccuccagugccgcaucuguauuuga

SEQ ID NO: 192197 - RNA, 1698 nt, Artificial Sequence
  derived and/or modified sequence opt5 from hemagglutinin__InfluenzaA__AFM85179
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucguugaaaccccgaaccccgagaauggcacguguuauccuggguacuuugccgauuaugaggaacugagagagcaacucuccucugugagcuccuucgaacgguuugagaucuuccccaaggagagcucuuggccuaaccauaccgucacaggaguguccgccagcugcucucacaauggcaaguccagcuuuuaccgcaaccugcuuuggcugaccggcaaaaaugggcucuaucccaaccugucuaaguccuacgcuaauaacaaagaaaaggagguucugauucucuggggagugcaucacccuccgaacaucggcgaccagagaacacuguacuauaccgaaaaugccuacgucagcgugguguccucucacuauagccggcgcuucacgcccgagauuacaaaaagaccuaagguccgggaucaggaagggcgcaucaacuacuauuggacccuucuggagcccggagacacaauuaucuuugaggcuaauggcaaccucauugccccuugguacgcguucgcccuguccagaggguuuggaagcggcaucaucauuucuaaugcucccauggaugaaugugacgccaagugccagaccccgcaaggcgcuaucaacuccagccuuccuuuccagaauguucaucccgugaccauuggggaguguccuaaauaugugcggucugccaagcugcgcauggucacaggacucagaaacauccccagcauucagucccggggccuguuuggggcgaucgccggauucaucgaaggcggguggacgggaaugguggauggcugguacggcuaccaccaucagaaugagcaagggucuggauaugcugccgaccagaaaagcacccagaacgcuauuaauggcaucacaaacaagguuaauuccgugauugaaaagaugaacacccaguuuacagccgucgggaaagaguucaauaaauucgagcgcagaauggaaaaccugaacaagaagguggaugacggauuucucgauaucuggaccuacaaugccgagcugcuuguucugcucgaaaacgagcggacgcuggacuuccacgacagcaaugugaaaaaccuuuaugaaaaggucaaaucucaacugaagaauaacgcuaaagagauuggcaaugggugcuuugaguucuaccacaaguguaacaaugaaugcauggaguccgugaagaacggcacauaugauuaccccaaauauagcgaagagucuaagcucaaucgcgagaaaaucgacggagucaagcuggaauccaugggcguguaccagauccuggcgauuuacagcaccguugccuccucucucgugcugcuugucagccugggggcuaucuccuuuuggaugugcucuaacggaagccuccaguguagaauuugcaucuga

SEQ ID NO: 192198 - RNA, 1701 nt, Artificial Sequence
  derived and/or modified sequence opt5 from hemagglutinin__InfluenzaA__AFN11846
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaagagcuuuuucucucgccucaacuggcugcacaaacuugaguacaaauauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucggcaauuguaacagcgagugcauuacccccaauggguccaucccgaacgacaaaccuuuucaaaaugugaaccgcaucacauauggagcuugucccagauacgugaagcagaauacgcuuaaacuggccaccggcaugcggaacgucccugaaaagcagacacgcgggauuuucggagcgaucgccggcuuuauugagaaugggugggaaggaaugguggauggcugguauggcuucagacaccagaacucugaggggaccggacaagcugccgaccucaaaagcacacaggcugccaucgaucagauuaauggcaagcugaaccggcuuaucgagaagaccaaugaaaaauuucaucaaaucgagaaggaguucuccgaaguugaagggcgcauucaggaccuggagaaauacguggaggauacgaagaucgaccucuggagcuauaacgccgaacugcuggucgcucucgagaaucagcacacaauugaucugaccgacucugaaaugaacaaacuuuucgagagaacccggaagcagcugagagaaaacgcggaggauaugggaaauggcugcuuuaagaucuaccauaaaugugacaacgccugcauuggguccauccgcaauggcacauacgaccacgauguguaucgggacgaggcucucaacaauagauuccaaauuaagggaguugaacugaaaagcggcuacaaggauuggauccuuuggaucucuuuugccauuuccugcuuccugcucugugugguccugcugggguuuaucaugugggccugccagaaaggaaacauucgcuguaauaucugcauuuga

SEQ ID NO: 192199 - RNA, 1701 nt, Artificial Sequence; identical to SEQ ID NO: 186554
  derived and/or modified sequence opt5 from hemagglutinin__InfluenzaA__AFN17371

SEQ ID NO: 192200 - RNA, 1701 nt, Artificial Sequence; identical to SEQ ID NO: 185693
  derived and/or modified sequence opt5 from hemagglutinin__InfluenzaA__AFN17381

SEQ ID NO: 192201 - RNA, 1701 nt, Artificial Sequence; identical to SEQ ID NO: 185693
  derived and/or modified sequence opt5 from hemagglutinin__InfluenzaA__AFN17391

SEQ ID NO: 192202 - RNA, 1701 nt, Artificial Sequence; identical to SEQ ID NO: 185693
  derived and/or modified sequence opt5 from hemagglutinin__InfluenzaA__AFN17401

SEQ ID NO: 192203 - RNA, 1701 nt, Artificial Sequence; identical to SEQ ID NO: 185693
  derived and/or modified sequence opt5 from hemagglutinin__InfluenzaA__AFN17411

SEQ ID NO: 192204 - RNA, 1701 nt, Artificial Sequence; identical to SEQ ID NO: 185693
  derived and/or modified sequence opt5 from hemagglutinin__InfluenzaA__AFN17421

SEQ ID NO: 192205 - RNA, 1701 nt, Artificial Sequence; identical to SEQ ID NO: 185784
  derived and/or modified sequence opt5 from hemagglutinin__InfluenzaA__AFN17431

SEQ ID NO: 192206 - RNA, 1701 nt, Artificial Sequence
  derived and/or modified sequence opt5 from hemagglutinin__InfluenzaA__AFN17441
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcaaggcuuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaaaggagugaccgccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccacaucugccgaucaacagagccucuaccagaacgcugacgccuacguguucgugggcaccuccagauauagcaaaaaguuuaaaccugagauugcuauccggccgaagguccgcgaucaggaggggagaaugaauuacuauuggacacugguugaacccggagacaaaauuaccuucgaggccacgggcaaccugguggugccucgguacgcguuugccauggaacgcaacgcugggucuggaaucauuaucuccgauacacccguccaugacugcaauaccacaugucaaaccccuaagggcgccaucaacaccagccuccccuuccagaauauucacccgaucacaauuggcaagugcccuaaauaugugaagucuacgaaacugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaucuuaagagcacccagaacgccaucgacgagauuacaaauaaagucaacuccgugaucgagaagaugaauacccaguuuacggcuguuggaaaggaguucaaccaccuggagaaaagaauugaaaaucugaacaagaaaguggaugacggcuuccucgauaucuggacauacaaugccgagcugcugguccuccuggaaaacgagcggacccuugacuaucaugauagcaaugugaagaaccuguacgagaaaguccgcucucagcucaagaacaaugccaaggaaauugggaacggauguuuugaguucuaucacaaaugcgacaauaccuguauggaauccgugaagaacggcacauacgauuauccuaaauacagcgaggaagcuaagcugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 192207 - RNA, 1701 nt, Artificial Sequence; identical to SEQ ID NO: 188248
  derived and/or modified sequence opt5 from hemagglutinin__InfluenzaA__AFN17451

SEQ ID NO: 192208 - RNA, 1701 nt, Artificial Sequence; identical to SEQ ID NO: 186535
  derived and/or modified sequence opt5 from hemagglutinin__InfluenzaA__AFN17467

SEQ ID NO: 192209 - RNA, 1701 nt, Artificial Sequence; identical to SEQ ID NO: 185693
  derived and/or modified sequence opt5 from hemagglutinin__InfluenzaA__AFN17477

SEQ ID NO: 192210 - RNA, 1701 nt, Artificial Sequence; identical to SEQ ID NO: 186554
  derived and/or modified sequence opt5 from hemagglutinin__InfluenzaA__AFN17487

SEQ ID NO: 192211 - RNA, 1701 nt, Artificial Sequence; identical to SEQ ID NO: 185693
  derived and/or modified sequence opt5 from hemagglutinin__InfluenzaA__AFN17497

SEQ ID NO: 192212 - RNA, 1701 nt, Artificial Sequence; identical to SEQ ID NO: 185693
  derived and/or modified sequence opt5 from hemagglutinin__InfluenzaA__AFN17507

SEQ ID NO: 192213 - RNA, 1701 nt, Artificial Sequence; identical to SEQ ID NO: 186535
  derived and/or modified sequence opt5 from hemagglutinin__InfluenzaA__AFN17517

SEQ ID NO: 192214 - RNA, 1701 nt, Artificial Sequence; identical to SEQ ID NO: 186554
  derived and/or modified sequence opt5 from hemagglutinin__InfluenzaA__AFN17527

SEQ ID NO: 192215 - RNA, 1701 nt, Artificial Sequence; identical to SEQ ID NO: 185693
  derived and/or modified sequence opt5 from hemagglutinin__InfluenzaA__AFN17537

SEQ ID NO: 192216 - RNA, 1701 nt, Artificial Sequence; identical to SEQ ID NO: 185935
  derived and/or modified sequence opt5 from hemagglutinin__InfluenzaA__AFN17547

SEQ ID NO: 192217 - RNA, 1701 nt, Artificial Sequence; identical to SEQ ID NO: 187224
  derived and/or modified sequence opt5 from hemagglutinin__InfluenzaA__AFN17557

SEQ ID NO: 192218 - RNA, 1701 nt, Artificial Sequence; identical to SEQ ID NO: 186535
  derived and/or modified sequence opt5 from hemagglutinin__InfluenzaA__AFN17567

SEQ ID NO: 192219 - RNA, 1701 nt, Artificial Sequence; identical to SEQ ID NO: 185935
  derived and/or modified sequence opt5 from hemagglutinin__InfluenzaA__AFN17574

SEQ ID NO: 192220 - RNA, 1701 nt, Artificial Sequence; identical to SEQ ID NO: 185693
  derived and/or modified sequence opt5 from hemagglutinin__InfluenzaA__AFN17580

SEQ ID NO: 192221 - RNA, 1701 nt, Artificial Sequence; identical to SEQ ID NO: 185693
  derived and/or modified sequence opt5 from hemagglutinin__InfluenzaA__AFN17586

SEQ ID NO: 192222 - RNA, 1701 nt, Artificial Sequence; identical to SEQ ID NO: 186554
  derived and/or modified sequence opt5 from hemagglutinin__InfluenzaA__AFN17595

SEQ ID NO: 192223 - RNA, 1701 nt, Artificial Sequence; identical to SEQ ID NO: 185693
  derived and/or modified sequence opt5 from hemagglutinin__InfluenzaA__AFN17605

SEQ ID NO: 192224 - RNA, 1701 nt, Artificial Sequence; identical to SEQ ID NO: 185693
  derived and/or modified sequence opt5 from hemagglutinin__InfluenzaA__AFN17615

SEQ ID NO: 192225 - RNA, 1701 nt, Artificial Sequence; identical to SEQ ID NO: 185693
  derived and/or modified sequence opt5 from hemagglutinin__InfluenzaA__AFN17625

SEQ ID NO: 192226 - RNA, 1701 nt, Artificial Sequence; identical to SEQ ID NO: 185693
  derived and/or modified sequence opt5 from hemagglutinin__InfluenzaA__AFN17635

SEQ ID NO: 192227 - RNA, 1701 nt, Artificial Sequence
  derived and/or modified sequence opt5 from hemagglutinin__InfluenzaA__AFN17645
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcguggagaucuuucccaagaccagcucuuggccuaaucacgauuccaacaagggaguuacagccgcuuguccccaugccggcgcgaaaucuuucuauaagaaucugaucuggcucgugaaaaagggcaacagcuacccuaaacuguccaagagcuauauuaaugacaaggggaaagaaguccuugugcuguggggaauccaccaccccuccaccucugccgaucaacagagccucuaccagaacgcugacgccuacguguuugucggcacauccagauauagcaagaaauucaagccugagauugcuauccggccgaaaguucgcgaucaggaggggagaaugaauuacuauuggacccugguggaacccggagacaagauuacguuugaggccacaggcaaccugguggucccucgguacgcguucgccauggaacgcaacgcugggucuggaaucauuaucuccgauacccccgugcaugacugcaauacaaccugucaaaccccuaaaggcgccaucaacacaagccuccccuuucagaauauucacccgaucacgauuggcaagugcccuaaguauguuaaaucuaccaagcugagacuugcuacagggcugcggaacgugcccagcauccagucccgcggacucuucggcgccauugccggguuuaucgagggaggcuggaccgggauggucgacggaugguacggcuaucaucaccagaaugaacaaggcucuggguacgcugcggaucugaaaagcacacagaacgccaucgacgagauuaccaauaaggugaacuccguuaucgagaaaaugaauacgcaguucacagcugugggaaaggaauuuaaccaccuugagaagagaauugaaaaucugaacaaaaaggucgaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugccaaggaaauugggaacggauguuucgaguuuuaucacaagugcgacaauacauguauggaauccguuaaaaacggcaccuacgauuauccuaaguacagcgaggaagcuaaacugaauagagaggagaucgacggggugaaacuugaaucuacacggaucuaucaaauucuggccaucuacuccacggucgcgagcucccucgugcugguugugucucugggcgcuauuagcuucuggaugugcuccaacggaucucuccagugccgcaucuguauuuga

SEQ ID NO: 192228 - RNA, 1701 nt, Artificial Sequence; identical to SEQ ID NO: 186554
  derived and/or modified sequence opt5 from hemagglutinin__InfluenzaA__AFN17655

SEQ ID NO: 192229 - RNA, 1701 nt, Artificial Sequence; identical to SEQ ID NO: 186554
  derived and/or modified sequence opt5 from hemagglutinin__InfluenzaA__AFN17665

SEQ ID NO: 192230 - RNA, 1701 nt, Artificial Sequence
  derived and/or modified sequence opt5 from hemagglutinin__InfluenzaA__AFN17675
augaaggccauccugauugugcuccuguacaccuucgcuacagccaacgcggacacgcuuugcaucggcuaucacgcuaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccgaaagcuauaucaaugacaaggggaaggagguucuugugcuguggggcauucaccaccccuccaccucugccgaucaacagagccucuaccagaacgcugacgccuacgucuucgugggaacauccagauauagcaaaaaguuuaaaccugagaucgcuauucggccgaaggugcgcgaucaggaagggagaaugaauuacuauuggacccuggucgagcccggagacaaaaucacguucgaagccacaggcaaccugguugugccucgguacgcguuugccauggagcgcaacgcugggucuggaauuaucaucuccgauacccccgugcaugacugcaauacaaccugucaaaccccuaagggcgccauuaacacaagccuccccuuccagaauauccacccgauuacgaucggcaaaugcccuaaguaugucaagucuaccaaacugagacuugcuacagggcugcggaacgugcccagcauucagucccgcggacucuuuggcgccaucgccggguucaucgaaggaggcuggaccgggaugguugacggaugguacggcuaucaucaccagaaugagcaaggcucuggguacgcugcggaucuuaagagcacacagaacgccauugacgagaucaccaauaaagugaacuccgucauugaaaagaugaauacgcaguuuacagcugugggaaaagaguucaaccaccuggaaaagagaaucgagaaucugaacaagaaaguugaugacggcuuccucgauauuuggaccuacaaugccgaacugcuggugcuccuggagaacgagcggacccuugacuaucaugauagcaaugucaagaaccuguacgaaaaagugcgcucucagcucaagaacaaugccaaagagaucgggaacggauguuuugaguucuaucacaagugcgacaauacauguauggaguccgucaagaacggcaccuacgauuauccuaaauacagcgaagaggcuaagcugaauagagaggaaaucgacggggugaaacuugagucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 192231 - RNA, 1701 nt, Artificial Sequence
  derived and/or modified sequence opt5 from hemagglutinin__InfluenzaA__AFN17685
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcugugggggauucaccaccccuccaccucugccgaucaacagagccucuaccagaacgcugacgccuacgucuucgugggcacauccagauauagcaagaaauuuaagccugagaucgcuauucggccgaaagugcgcgaucaggaggggagaaugaauuacuauuggacccuggucgaaccccgggacaagaucacguucgaggccacaggaaaccugguugugccucgcuacgcguuugccauggaaagaaacgcuggcucugggauuaucaucuccgauacccccgugcaugacugcaauacaaccugucaaaccccuaaaggagccauuaacacaagccuccccuuccagaauauccacccgauuacgaucggcaagugcccuaaguaugucaaaucuaccaagcugcggcuugcuacaggccugcgcaacgugcccagcauucaguccagagggcucuuuggagccaucgccggcuucaucgagggaggauggaccggcaugguugacgggugguacggauaucaucaccagaaugaacaaggcucuggcuacgcugcggaucugaaaagcacacagaacgccauugacgagaucaccaauaaggugaacuccgucauugagaaaaugaauacgcaguuuacagcuguggggaaggaguucaaccaccuugagaagcggaucgaaaaucugaacaaaaagguugaugacggauuccucgauauuuggaccuacaaugccgagcugcuggugcuccuggaaaacgagcgcacccuugacuaucaugauagcaaugucaaaaaccuguacgagaaggugagaucucagcucaaaaacaaugccaaggaaaucggcaacggguguuuugaguucuaucacaagugcgacaauacauguauggaauccgucaaaaacggaaccuacgauuauccuaaguacagcgaggaagcuaaacugaaucgggaggagaucgacggcgugaaacuugaaucuacacgcauuuaucaaauccuggccauuuacuccacgguugcgagcucccucgugcuggucgugucucugggggcuaucagcuuuuggaugugcuccaacggcucucuccagugcagaauuuguaucuga

SEQ ID NO: 192232 - RNA, 1701 nt, Artificial Sequence; identical to SEQ ID NO: 185693
  derived and/or modified sequence opt5 from hemagglutinin__InfluenzaA__AFN17695

SEQ ID NO: 192233 - RNA, 1701 nt, Artificial Sequence; identical to SEQ ID NO: 185693
  derived and/or modified sequence opt5 from hemagglutinin__InfluenzaA__AFN17705

SEQ ID NO: 192234 - RNA, 1701 nt, Artificial Sequence; identical to SEQ ID NO: 186322
  derived and/or modified sequence opt5 from hemagglutinin__InfluenzaA__AFN17715

SEQ ID NO: 192235 - RNA, 1701 nt, Artificial Sequence
  derived and/or modified sequence opt5 from hemagglutinin__InfluenzaA__AFN17725
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgcagguccgcgaucaagaggggagaaugaauuacuauuggacccugguugaacccggagacaaaauuacguucgaggccacaggcaaccugguggugccucgguacgcguuugccauggaacgcaacgcugggucuggaaucauuaucuccgauacccccguccaugacugcaauacaaccugucagaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgagggaggcuggaccgggaugguggacggaugguacggcuaucaucaccaaaaugaacagggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagagaauugaaaaucugaacaagaaaguggaugacggcuuccucgauaucuggaccuacaaugccgagcugcugguccuccuggaaaacgagcggacccuugacuaucaugauagcaaugugaagaaccuguacgagaaaguccgcucucaacucaagaacaaugccaaagaaauugggaacggauguuuugaguucuaucacaagugcgacaauacauguauggaauccgugaagaacggcaccuacgauuauccuaaauacagcgaggaagcuaagcugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 192236 - RNA, 1701 nt, Artificial Sequence; identical to SEQ ID NO: 185693
  derived and/or modified sequence opt5 from hemagglutinin__InfluenzaA__AFN17735

SEQ ID NO: 192237 - RNA, 1701 nt, Artificial Sequence; identical to SEQ ID NO: 185693
  derived and/or modified sequence opt5 from hemagglutinin__InfluenzaA__AFN17742

SEQ ID NO: 192238 - RNA, 1701 nt, Artificial Sequence; identical to SEQ ID NO: 185693
  derived and/or modified sequence opt5 from hemagglutinin__InfluenzaA__AFN17748

SEQ ID NO: 192239 - RNA, 1701 nt, Artificial Sequence; identical to SEQ ID NO: 185693
  derived and/or modified sequence opt5 from hemagglutinin__InfluenzaA__AFN17757

SEQ ID NO: 192240 - RNA, 1701 nt, Artificial Sequence; identical to SEQ ID NO: 186322
  derived and/or modified sequence opt5 from hemagglutinin__InfluenzaA__AFN17767

SEQ ID NO: 192241 - RNA, 1701 nt, Artificial Sequence; identical to SEQ ID NO: 190703
  derived and/or modified sequence opt5 from hemagglutinin__InfluenzaA__AFN17774

SEQ ID NO: 192242 - RNA, 1701 nt, Artificial Sequence; identical to SEQ ID NO: 185693
  derived and/or modified sequence opt5 from hemagglutinin__InfluenzaA__AFN17783

SEQ ID NO: 192243 - RNA, 1701 nt, Artificial Sequence; identical to SEQ ID NO: 186322
  derived and/or modified sequence opt5 from hemagglutinin__InfluenzaA__AFN17793

SEQ ID NO: 192244 - RNA, 1701 nt, Artificial Sequence; identical to SEQ ID NO: 185693
  derived and/or modified sequence opt5 from hemagglutinin__InfluenzaA__AFN17803

SEQ ID NO: 192245 - RNA, 1701 nt, Artificial Sequence; identical to SEQ ID NO: 185693
  derived and/or modified sequence opt5 from hemagglutinin__InfluenzaA__AFN17813

SEQ ID NO: 192246 - RNA, 1701 nt, Artificial Sequence
  derived and/or modified sequence opt5 from hemagglutinin__InfluenzaA__AFN17823
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccgaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 192247 - RNA, 1701 nt, Artificial Sequence
  derived and/or modified sequence opt5 from hemagglutinin__InfluenzaA__AFN17833
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuugucccaaugccggcgcgaaaucuuuuuauaagaaccugaucuggcucguuaaaaagggcaauagcuacccuaaacuguccaagagcuauauuaacgacaaggggaaagaagugcuuguccuguggggaauccaucaccccuccaccucugccgaucaacagagccucuaccagaaugcugacgccuacguguucgugggcacauccagauauagcaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggucuggaaucauuaucuccgauacccccguccacgacugcaacacaaccugucaaaccccuaaaggcgccaucaauacaagccuccccuuccagaacauucauccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaccaucagaacgaacaaggcucuggguacgcugcggaucugaaaagcacacagaaugccaucgacgagauuaccaacaaggucaauuccgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucacgauagcaacgugaaaaaccuguacgagaagguccgcucucagcucaaaaauaacgccaaggaaauugggaauggauguuuugaguucuaucauaagugcgacaacacauguauggaauccgugaaaaauggcaccuacgauuauccuaaguacagcgaggaagcuaaacugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 192248 - RNA, 1701 nt, Artificial Sequence; identical to SEQ ID NO: 190202
  derived and/or modified sequence opt5 from hemagglutinin__InfluenzaA__AFN17843

SEQ ID NO: 192249 - RNA, 1701 nt, Artificial Sequence; identical to SEQ ID NO: 185693
  derived and/or modified sequence opt5 from hemagglutinin__InfluenzaA__AFN17853

SEQ ID NO: 192250 - RNA, 1701 nt, Artificial Sequence; identical to SEQ ID NO: 185935
  derived and/or modified sequence opt5 from hemagglutinin__InfluenzaA__AFN17863

SEQ ID NO: 192251 - RNA, 1701 nt, Artificial Sequence
  derived and/or modified sequence opt5 from hemagglutinin__InfluenzaA__AFN17873
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccggcuccuggucuuacaucguggagaccagcuccucugacaacgggacgugcuauccgggagauuuuauugacuacgaagaacugcgggagcagcuuagcuccgucagcucuuucgaacgcuuugagaucuuccccaagaccuccagcuggccuaaucacgaucugaacaagggcgugacagccgcuuguccccaugccggcgcgaaaucuuuuuauaagaaucucaucuggcugguuaaaaaggggaacuccuacccuaaacuuagcaagucuuauauuaaugacaagggaaaagaagugcugguccucuggggcauccaccaccccuccaccagcgccgaucaacagucccuguaccagaacgcugacgccuacguguucguggggacaucuagauauagcaagaaauuuaagccugagauugcuauccggccgaaaguccgcgaucaggagggaagaaugaauuacuauuggacccugguugaacccggcgacaagauuacguucgaggccacagggaaccucguggugccucgguacgcguuugccauggaacgcaacgcuggauccggcaucauuaucagcgauacccccguccaugacugcaauacaaccugucaaaccccuaaaggcgccaucaacacaucucugcccuuccagaauauucacccgaucacgauugggaagugcccuaaguaugugaaauccaccaaacuuagacuggcuacaggacuccggaacguucccagcauccagucucgcggccuguuuggggccauugccggauucaucgagggcggguggaccggaaugguggacggcugguacggcuaucaucaccagaaugaacaagggagcggauacgcugcggaucuuaaguccacacagaacgccaucgacgagauuaccaauaaggucaacucugugaucgagaaaaugaauacgcaguuuacagcuguuggcaaggaguucaaccaccuggagaagagaauugaaaaucucaacaaaaagguggaugacggguuccuggauaucuggaccuacaaugccgagcugcucguccugcuugaaaacgagcggacccuggacuaucaugauagcaaugugaaaaaccucuacgagaagguccgcucccagcugaaaaacaaugccaaggaaauuggaaacggcuguuuugaguucuaucacaagugcgacaauacauguauggaaagcgugaaaaacgggaccuacgauuauccuaaguacucugaggaagcuaaacuuaauagagaggagaucgacggcguuaagcuggaauccacacggaucuaucaaauucucgccaucuacagcacgguggcgucuucccugguccuggugguuagccucggagcuauuuccuuuuggaugugcucuaacggcagccugcagugccgcaucuguauuuga

SEQ ID NO: 192252 - RNA, 1701 nt, Artificial Sequence
  derived and/or modified sequence opt5 from hemagglutinin__InfluenzaA__AFN17883
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaacccucaaaggcgccaucaacacaagccugccuuuccagaauauucaccccaucacgauuggcaagugcccgaaguaugugaaaucuaccaaacuuagacuggcuacagggcuccggaacguuccuagcauccagucccgcggacuguuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaggucaacuccgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauagcaaugugaaaaaccucuacgagaagguccgcucucagcugaaaaacaaugccaaggaaauugggaacggauguuuugaguucuaucacaagugcgacaauacauguauggaauccgugaaaaacggcaccuacgauuaucccaaguacagcgaggaagcuaaacuuaauagagaggagaucgacgggguuaagcuggaaucuacacggaucuaucaaauucucgccaucuacuccacgguggcgagcucccugguccuggugguuucucucggcgcuauuagcuuuuggaugugcuccaacggaucucugcagugccgcaucuguauuuga

SEQ ID NO: 192253 - RNA, 1701 nt, Artificial Sequence; identical to SEQ ID NO: 185693
  derived and/or modified sequence opt5 from hemagglutinin__InfluenzaA__AFN17893

SEQ ID NO: 192254 - RNA, 1701 nt, Artificial Sequence
  derived and/or modified sequence opt5 from hemagglutinin__InfluenzaA__AFN17903
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaauccaacaagggagugacagccgcuuguccccaugccggcgcgaaaucuuuuuauaagaaucugaucuggcucguuaaaaagggcaacagcuacccuaaacuguccaagagcuaugugaaugauaaggggaaagagguccuugugcuguggggcauucaccaccccuccaccucugccgaccaacagagccucuaccagaacgcugaugccuacguguucgucggaacauccagauauagcaagaaauuuaagccugagaucgcuauucggccgaaaguucgcgaccaggaagggagaaugaauuacuauuggacccugguggagcccggagauaagaucacguucgaagccacaggcaaccugguggucccucgguacgcguuugccauggagcgcaacgcugggucuggaauuaucauuuccgacacccccgugcaugauugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugaaggaggcuggaccgggauggucgacggaugguacggcuaucaucaccagaaugagcaaggcucuggguacgcugcggaccugaaaagcacacagaacgccaucgaugagaucaccaauaaggugaacuccguuauugaaaagaugaauacgcaguuuacagcugugggaaaggaguucaaccaccuugaaaagagaaucgagaaucugaacaaaaaggucgacgauggcuuccucgacauuuggaccuacaaugccgaacugcuggugcuccuggagaacgagcggacccuugauuaucaugacagcaaugucaaaaaccuguacgaaaaggugcgcucucagcucaaaaacaaugccaaggagaucgggaacggauguuuugaguucuaucacaagugcgauaauacauguauggaguccguuaaaaacggcaccuacgacuauccuaaguacagcgaagaggcuaaacugaauagagaggaaauugauggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 192255 - RNA, 1701 nt, Artificial Sequence; identical to SEQ ID NO: 186046
  derived and/or modified sequence opt5 from hemagglutinin__InfluenzaA__AFN17919

SEQ ID NO: 192256 - RNA, 1701 nt, Artificial Sequence; identical to SEQ ID NO: 185935
  derived and/or modified sequence opt5 from hemagglutinin__InfluenzaA__AFN17929

SEQ ID NO: 192257 - RNA, 1701 nt, Artificial Sequence; identical to SEQ ID NO: 191951
  derived and/or modified sequence opt5 from hemagglutinin__InfluenzaA__AFN17939

SEQ ID NO: 192258 - RNA, 1701 nt, Artificial Sequence; identical to SEQ ID NO: 186554
  derived and/or modified sequence opt5 from hemagglutinin__InfluenzaA__AFN17949

SEQ ID NO: 192259 - RNA, 1701 nt, Artificial Sequence
  derived and/or modified sequence opt5 from hemagglutinin__InfluenzaA__AFN17959
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuaugugaaugacaaggggaaagaaguccuugugcuguggggcauucaccaccccuccaccucugccgaucaacagagccucuaccagaacgcugacgccuacguguucgucggaacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 192260 - RNA, 1701 nt, Artificial Sequence; identical to SEQ ID NO: 187375
  derived and/or modified sequence opt5 from hemagglutinin__InfluenzaA__AFN17969

SEQ ID NO: 192261 - RNA, 1701 nt, Artificial Sequence; identical to SEQ ID NO: 186554
  derived and/or modified sequence opt5 from hemagglutinin__InfluenzaA__AFN17979

SEQ ID NO: 192262 - RNA, 1701 nt, Artificial Sequence
  derived and/or modified sequence opt5 from hemagglutinin__InfluenzaA__AFN17989
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucggaaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaagguccgcucucagcucaaaaacaaugccaaggagauuggaaacggcuguuuugaguucuaucacaagugcgacaauacauguauggaguccgugaaaaacgggaccuacgauuauccuaaguacagcgaagaggcuaaacugaauagagaagagaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 192263 - RNA, 1701 nt, Artificial Sequence; identical to SEQ ID NO: 185693
  derived and/or modified sequence opt5 from hemagglutinin__InfluenzaA__AFN17999

SEQ ID NO: 192264 - RNA, 1701 nt, Artificial Sequence
  derived and/or modified sequence opt5 from hemagglutinin__InfluenzaA__AFN18019
augaaggccauccuggugguccuccuguacaccuucgcuacagccaaagcggacacgcuuugcauuggcuaucacgcuaacaauagcaccgauacaguugacaccgugcuggagaagaacgugacagucacccauuccgugaaucuccuggaagauaaacacaacgggaagcuguguaaacugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagauguuccccaagaccagcucuuggccuaaccacgauuccaauaaaggagugacagccgcuuguccccaugccggcgccaagagcuuuuauaaaaaccugaucuggcucguuaagaaaggcaauucuuacccuaagcuguccaagagcuauaucaacgacaaagggaaggaagugcuuguccuguggggcauucaccaccccuccaccucugccgaucaacagagccucuaccagaaugcugacgccuacguguucgugggaacauccagauauagcaaaaaguuuaaaccugagaucgcuauucggccgaagguccgcgaucaggaggggagaaugaacuacuauuggacccugguugaacccggagacaaaaucacguucgaggccacaggcaaucugguggugccucgguacgcguuugccauggaacgcaacgcugggucuggaauuaucauuuccgauacccccguccaugacugcaacacaaccugucaaaccccuaagggcgccaucaauacaagccuccccuuccagaacauccacccgauuacgaucggcaagugcccuaaauaugugaagucuaccaaacugagacuugcuacagggcugcggaauguucccagcauucagucccgcggacucuuuggcgccaucgccggguucauugagggaggcuggaccgggaugguggacggaugguacggcuaucaucaccagaacgaacaaggcucuggguacgcugcggaucuuaagagcacacagaaugccaucgacgagaucaccaacaaagucaauuccgugauugagaagaugaacacgcaguuuacagcuguuggaaaggaguucaaucaccuugagaaaagaaucgaaaaccugaauaagaaaguggaugacggcuuccucgauauuuggaccuacaacgccgagcugcugguccuccuggaaaaugagcggacccuugacuaucaugauagcaacgugaagaaucuguacgagaaaguccgcucucagcucaagaacaacgccaaggaaaucgggaauggauguuuugaguucuaucacaaaugcgacaacacauguauggaauccgugaagaauggcaccuacgauuauccuaaauacagcgaggaagcuaagcugaacagagaggagauugacgggguuaaacuugaaucuacacggaucuaucaaauccuggccauuuacuccacgguggcgagcucccucguccuggugguuucucugggcgcuaucagcuuuuggaugugcuccaauggaucucuccagugccgcauuuguaucuga

SEQ ID NO: 192265 - RNA, 1701 nt, Artificial Sequence; identical to SEQ ID NO: 186554
  derived and/or modified sequence opt5 from hemagglutinin__InfluenzaA__AFN18039

SEQ ID NO: 192266 - RNA, 1701 nt, Artificial Sequence; identical to SEQ ID NO: 185693
  derived and/or modified sequence opt5 from hemagglutinin__InfluenzaA__AFN18049

SEQ ID NO: 192267 - RNA, 1701 nt, Artificial Sequence
  derived and/or modified sequence opt5 from hemagglutinin__InfluenzaA__AFN18059
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaaugcuuguauggaauccgugaaaaacggcacauacgauuauccuaaguacagcgaggaagccaaacugaauagagaggagaucgacgggguuaaacuugaaucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 192268 - RNA, 1701 nt, Artificial Sequence; identical to SEQ ID NO: 185693
  derived and/or modified sequence opt5 from hemagglutinin__InfluenzaA__AFN18078

SEQ ID NO: 192269 - RNA, 1701 nt, Artificial Sequence
  derived and/or modified sequence opt5 from hemagglutinin__InfluenzaA__AFN18088
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgaugguccgcaacgccgggucuggaaucauuaucuccgauacacccgugcaugacugcaauaccaccugucaaacaccuaaaggcgcuaucaacacgagccuccccuuccagaauauucacccgaucaccauuggcaagugcccuaaguauguuaaaucuacaaagcugagacuugccaccgggcugcggaacgugcccagcauccagucccgcggacucuuuggcgcuauugccggguucaucgaaggaggcuggacagggauggucgacggaugguacggcuaucaucaccagaaugagcaaggcucuggguacgccgcugaucugaaaagcacccagaacgcgaucgacgaaauuacgaauaaggugaacuccguuaucgagaaaaugaauacacaguuuaccgccgugggaaaggaguucaaccaccuugaaaagagaauugagaaucugaacaaaaaggucgaugacggcuuccucgauaucuggaccuacaaugcugaacugcuggugcuccuggagaacgaacggacacuugacuaucaugauagcaaugucaaaaaccuguacgagaaggugcgcucucagcucaaaaacaaugccaaggagauugggaacggauguuuugaguucuaucacaagugcgacaauaccuguauggaguccguuaaaaacggcacauacgauuauccuaaguacagcgaagaggccaaacugaauagagaagagaucgacggggugaaacuugagucuacgcggaucuaucaaauucuggcuaucuacuccaccgucgccagcucccucgugcugguugugucucugggcgcgauuagcuuuuggaugugcuccaacggaucucuccagugccgcaucuguauuuga

SEQ ID NO: 192270 - RNA, 1701 nt, Artificial Sequence
  derived and/or modified sequence opt5 from hemagglutinin__InfluenzaA__AFN18098
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccggggaauuuuaucgauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuaaacuguccaagagcuauaucaacgauaaggggaaagaaguucuugugcuguggggcauucaccaccccuccaccucugccgaccaacagagccucuaccagaaugcugaugccuacgucuucgugggaacauccagauauagcaagaaauuuaagccugagaucgcuauucggccgaaagugcgcgaccaggaggggagaaugaacuacuauuggacccuggucgaacccggagauaagaucacguucgaggccacaggcaaccugguugugccucgguacgcguuugccguggaacgcaaugcugggucuggaauuaucaucuccgacacccccguccaugauugcaacacaaccugucaaaccccuaaaggcgccauuaauacaagccuccccuuccagaacauccacccgauuacgaucggcaagugcccuaaguaugugaaaucuaccaagcugagacuugcuacagggcugcggaauguucccagcauucagucccgcggacucuuuggcgccaucgccggguucaucgagggaggcuggaccgggaugguggacggaugguacggcuaucaucaccagaacgaacaaggcucuggguacgcugcggaccugaaaagcacacagaaugccauugaugagaucaccaacaaggucaauuccgugauugagaaaaugaacacgcaguuuacagcuguuggaaaggaguucaaucaccuugagaagagaaucgaaaaccugaauaaaaagguggacgauggcuuccucgacauuuggaccuacaacgccgagcugcugguccuccuggaaaaugagcggacccuugauuaucaugacagcaacgugaaaaaccuguacgagaagguccgcucucagcucaaaaauaacgccaaggaaaucgggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggauuuaucaaauccuggccauuuacuccacgguggcgagcucccucguccuggugguuucucugggcgcuaucagcuuuuggaugugcuccaauggaucucuccagugccgcauuuguaucuga

SEQ ID NO: 192271 - RNA, 1701 nt, Artificial Sequence
  derived and/or modified sequence opt5 from hemagglutinin__InfluenzaA__AFN18105
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaauccuuuuauaagaaucugauuuggcucgugaaaaagggcaacucuuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaacugucaaaccccuaaaggcgccauuaauaccagccuccccuuccagaacauccacccgauuacaaucggcaagugcccuaaguaugucaaaucuacgaagcugagacuugcuaccgggcugcggaaugugcccagcauucagucccgcggacucuuuggcgccaucgccggguucaucgagggaggcuggacagggaugguugacggaugguacggcuaucaucaccagaacgaacaaggcucuggguacgcugcggaucugaaaagcacccagaaugccauugacgagaucacaaacaaggugaauagcgucauugagaaaaugaacacccaguuuacggcugugggaaaggaguucaaucaccuugagaagagaaucgaaaaccugaauaaaaagguugaugacggcuuccucgauauuuggacauacaacgccgagcugcuggugcuccuggaaaaugagcggacccuugacuaucaugauagcaacgucaaaaaccuguacgagaaggugcgcucucagcucaaaaauaacgccaaggaaaucgggaauggauguuuugaguucuaucacaagugcgacaacaccuguauggaauccgucaaaaauggcacauacgauuauccuaaguacagcgaggaagcuaaacugaacagagaggagaucgacggggugaaacuugaaucuacccggauuuaucaaauccuggccauuuacuccacaguugcgagcucccucgugcuggucgugucucugggcgcuaucagcuuuuggaugugcuccaauggaucucuccagugccgcauuuguaucuga

SEQ ID NO: 192272 - RNA, 1701 nt, Artificial Sequence; identical to SEQ ID NO: 185935
  derived and/or modified sequence opt5 from hemagglutinin__InfluenzaA__AFN18107

SEQ ID NO: 192273 - RNA, 1701 nt, Artificial Sequence; identical to SEQ ID NO: 192267
  derived and/or modified sequence opt5 from hemagglutinin__InfluenzaA__AFN18117

SEQ ID NO: 192274 - RNA, 1701 nt, Artificial Sequence; identical to SEQ ID NO: 185693
  derived and/or modified sequence opt5 from hemagglutinin__InfluenzaA__AFN18119

SEQ ID NO: 192275 - RNA, 1701 nt, Artificial Sequence
  derived and/or modified sequence opt5 from hemagglutinin__InfluenzaA__AFN18121
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgcggagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucaacagagccucuaccagaacgcugacgccuacguguucgugggcacauccagauauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggucagaaacgcugggucuggaaucauuaucuccgauacccccgugcaugacugcaauacaaccugucaaaccccuaagggcgccaucaacacaagccuccccuuccagaauauucacccgaucacgauuggcaaaugcccuaaguauguuaagucuaccaaacugcggcuugcuacagggcugcgcaacgugcccagcauccaguccagaggacucuuuggcgccauugccggguucaucgaaggaggcuggaccgggauggucgacggaugguacggcuaucaucaccagaaugagcaaggcucuggguacgcugcggaucuuaagagcacacagaacgccaucgacgaaauuaccaauaaagugaacuccguuaucgagaagaugaauacgcaguuuacagcugugggaaaagaguucaaccaccuggaaaagcggauugagaaucugaacaagaaagucgaugacggcuuccucgauaucuggaccuacaaugccgaacugcuggugcuccuggagaacgaacgcacccuugacuaucaugauagcaaugucaagaaccuguacgagaaagugagaucucagcucaagaacaaugccaaagagauugggaacggauguuuugaguucuaucacaagugcgacaauacauguauggaguccguuaagaacggcaccuacgauuauccuaaauacagcgaagaggcuaagcugaaucgggaagagaucgacggggugaaacuugagucuacacgcaucuaucaaauucuggccaucuacuccacggucgcgagcucccucgugcugguugugucucugggcgcuauuagcuuuuggaugugcuccaacggaucucuccagugcagaaucuguauuuga

SEQ ID NO: 192276 - RNA, 1701 nt, Artificial Sequence; identical to SEQ ID NO: 192267
  derived and/or modified sequence opt5 from hemagglutinin__InfluenzaA__AFN18133

SEQ ID NO: 192277 - RNA, 1701 nt, Artificial Sequence; identical to SEQ ID NO: 191951
  derived and/or modified sequence opt5 from hemagglutinin__InfluenzaA__AFN18135

SEQ ID NO: 192278 - RNA, 1701 nt, Artificial Sequence; identical to SEQ ID NO: 186535
  derived and/or modified sequence opt5 from hemagglutinin__InfluenzaA__AFN18137

SEQ ID NO: 192279 - RNA, 1701 nt, Artificial Sequence
  derived and/or modified sequence opt5 from hemagglutinin__InfluenzaA__AFN18139
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagggccucuaccagaacgcugacgccuacguguucguggggagcuccagauauagcaaaaaguuuaaaccugagauugcuauccggccgaagguccgcgaucaggaaggaagaaugaauuacuauuggacacugguugagcccggcgacaaaauuaccuucgaagccacggggaaccugguggugccucgguacgcguuugccauggagcgcaacgcuggaucuggcaucauuaucuccgauacacccguccaugacugcaauaccacaugucaaaccccuaagggcgccaucaacaccagccuccccuuccacaauauucauccgaucacaauugggaaaugcccuaaguaugugaagucuacgaaacugagacuugcuaccggacugcggaacguucccagcauccagucccgcggccucuuuggggccauugccggauucaucgaaggcggguggacaggaaugguggacggcugguacggcuaucaccaccagaaugagcaggggucuggauacgcugcggaucuuaagagcacccaaaacgccaucgacgagauuacaaauaaagucaacuccgugaucgaaaagaugaauacccaguuuacggcuguuggcaaagaguucaaccaucuugaaaagagaauugagaaucugaacaagaaaguggaugacggguuccucgauaucuggacauacaaugccgaacugcugguccuccuggagaacgagcggacccuugacuaucacgauagcaaugugaagaaccuguacgaaaaaguccgcucucagcucaagaacaaugccaaagagauuggaaacggcuguuuugaguucuaucauaagugcgacaauaccuguauggaauccgugaagaacgggacauacgauuauccuaaauacagcgaagaggcuaagcugaauagagaggaaaucgacggcguuaaacuugagucuacccggaucuaucagauucuggccaucuacuccacaguggcgagcucccucguccuggugguuucucugggagcuauuagcuuuuggaugugcuccaacggcucucuccaaugccgcaucuguauuuga

SEQ ID NO: 192280 - RNA, 1701 nt, Artificial Sequence; identical to SEQ ID NO: 192275
  derived and/or modified sequence opt5 from hemagglutinin__InfluenzaA__AFN18141

SEQ ID NO: 192281 - RNA, 1701 nt, Artificial Sequence; identical to SEQ ID NO: 186554
  derived and/or modified sequence opt5 from hemagglutinin__InfluenzaA__AFN18148

SEQ ID NO: 192282 - RNA, 1701 nt, Artificial Sequence; identical to SEQ ID NO: 186857
  derived and/or modified sequence opt5 from hemagglutinin__InfluenzaA__AFN18155

SEQ ID NO: 192283 - RNA, 1701 nt, Artificial Sequence
  derived and/or modified sequence opt5 from hemagglutinin__InfluenzaA__AFN18157
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacgcuuucguggggacauccagauauagcaagaaauuuaagccugagauugccauccggccgaaagugcgcgaccaggagggaagaaugaauuacuauuggacccuggucgaacccggcgauaagauuacguucgaggcgacagggaaccugguugugccucgguacgccuuugcuauggaacgcaacgccggaucuggcaucauuaucuccgacacccccgugcaugauugcaauacaaccugucaaaccccuaaaggcgcuaucaacacaagccuccccuuccagaauauucacccgaucacgauugggaagugcccuaaguaugucaaaucuaccaagcugagacuugccacaggacugcggaacgugcccagcauccagucccgcggccucuuuggggccauugcuggauucaucgagggcggguggaccggaaugguugacggcugguacggcuaucaucaccagaaugaacaagggucuggauacgcggccgaccugaaaagcacacagaacgcuaucgaugagauuaccaauaaggugaacuccgucaucgagaaaaugaauacgcaguuuacagccgugggcaaggaguucaaccaccuugagaagagaauugaaaaucugaacaaaaagguugacgauggguuccucgacaucuggaccuacaaugccgagcugcuggugcuccuggaaaacgagcggacccuugauuaucaugacagcaaugucaaaaaccuguacgagaaggugcgcucucagcucaaaaacaaugcuaaggaaauuggaaacggcuguuuugaguucuaucacaagugcgauaauacauguauggaauccgucaaaaacgggaccuacgacuauccuaaguacagcgaggaagccaaacugaauagagaggagaucgauggcgugaaacuugaaucuacacggaucuaucaaauucuggcgaucuacuccacgguugcuagcucccucgugcuggucgugucucugggagccauuagcuuuuggaugugcuccaacggcucucuccagugccgcaucuguauuuga

SEQ ID NO: 192284 - RNA, 1701 nt, Artificial Sequence
  derived and/or modified sequence opt5 from hemagglutinin__InfluenzaA__AFN18159
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcuccccuccaucugggcaagugcaacaucgccggguggauucugggaaauccugaaugugagucucucagcacagccuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcagcaagucuuuuuauaaaaaucugaucuggcucguuaagaaaggcaacuccuacccuaagcugagcaaauccuauauuaaugacaaggggaaggaggugcuuguccuguggggaauccaccaccccucuaccagcgcggaucaacagucccucuaccagaacgccgacgcuuacguguucgugggcagcucuagauauuccaaaaaguuuaaaccugagauugccauccggccgaagguccgcgaucaggaagggagaaugaauuacuauuggacacugguugagcccggagacaaaauuaccuucgaagcuacgggcaaccugguggugccucgguacgccuuugcgauggagcgcaacgccgggagcggaaucauuaucucugauacacccguccaugacugcaauaccacaugucaaaccccuaagggcgcuaucaacaccagccuccccuuccacaauauucauccgaucacaauuggcaaaugcccuaaguaugugaaguccacgaaacugagacuugccaccgggcugcggaacguucccucuauccagagccgcggacucuuuggcgcuauugccggguucaucgaaggaggcuggacagggaugguggacggaugguacggcuaucaccaccagaaugagcagggcuccggguacgccgcugaucuuaagagcacccaaaacgcgaucgacgagauuacaaauaaagucaacucugugaucgaaaagaugaauacccaguuuacggccguuggaaaagaguucaaccaucuugaaaagagaauugagaaucugaacaagaaaguggaugacggcuuccucgauaucuggacauacaaugcugaacugcugguccuccuggagaacgagcggacccuugacuaucacgauuccaaugugaagaaccuguacgaaaaaguccgcaaccagcucaagaauaacgccaaagagauugggaauggauguuuugaguucuaucauaagugcgacaacaccuguauggaaagcgugaagaauggcacauacgauuauccuaaauacucugaagaggccaagcugaacagagaggaaaucgacgggguuaaacuugaguccacccggaucuaucagauucuggcuaucuacagcacaguggccuccucucucguccuggugguuagccugggcgcgauuuccuuuuggaugugcucuaauggaagccuccaaugccgcaucuguauuuga

SEQ ID NO: 192285 - RNA, 1701 nt, Artificial Sequence
  derived and/or modified sequence opt5 from hemagglutinin__InfluenzaA__AFN18164
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaggaacugcgggagcagcuuuccagcgucucuuccuucgaacgcuuugagaucuuccccaagacaagcucuuggccuaaucacgauuccaacaagggagugaccgcugccuguccccaugcuggcgccaaauccuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugaucgugccucgguacgccuuugcgauggaacgcaacgccgggucuggaauuaucaucuccaauacacccgugcaugauugcaacaccaccugucaaacaccuaaaggcgcuauuaauacgagccuccccuuccagaacauccacccgauuaccaucggcaagugcccuaaguaugucaaaucuacaaagcugagacuugccaccgggcugcggaaugugcccagcauucagucccgcggacucuuuggcgcuaucgccggguucaucgagggaggcuggacagggaugguugacggaugguacggcuaucaucaccagaacgaacaaggcucuggguacgccgcugaccugaaaagcacccagaaugcgauugauaagaucacgaacaaagugaauagcgucauugagaagaugaacacacaguuuaccgccgugggaaaggagcuuaaucaccuggaaaagagaaucgagaaccucaauaagaaaguugacgauggcuuccuggacauuuggaccuacaacgcugaacugcucgugcugcuugagaaugaacggacacuggauuaucaugacagcaacgucaagaaccucuacgagaaagugcgcucucagcugaagaauaacgccaaggagaucgggaauggauguuucgaauuuuaucacaaaugcgauaacaccuguauggaguccgucaagaauggcacauacgacuauccuaaauacagcgaagaggccaaacuuaacagagaagagaucgauggggugaaacuggagucuacgcggauuuaucaaauccucgcuguuuacuccaccguggccagcucccugguccuggugguuucucucggcgcgauuagcuucuggaugugcuccaauggaucucugcagugccgcaucuguauuuga

SEQ ID NO: 192286 - RNA, 1701 nt, Artificial Sequence
  derived and/or modified sequence opt5 from hemagglutinin__InfluenzaA__AFN18171
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacucugggaaacuuuguaagcugagaggaguugcuccccuccaucugggcaaaugcaauaucgccggguggauucugggaaacccugagugugaaagccucuccacagccucuagcugguccuacaucguggagaccucuagcuccgacaauggcaagugcuauccgggggauuuuauugacuacgaagaacugcgggagcagcuuagcucugucuccagcuucgaacgcuuugagaucuuccccaagacgucuuccuggccuaaccacgauagcaauaaaggagugaccgccgcuuguccccaugccggcgcgaagucuuuuuauaaaaaccugaucuggcucguuaagaaaggcaauuccuacccuaagcugagcaaguccuauauuaacgacaaagggaaggaagugcuuguccuguggggaauccaccaccccucuacaagcgccgaucaacagucccucuaccagaaugcugacgccuacguguucgugggcaccagcaaauauucuaagaaauuuaagccugagauugcuaucagaccgaaaguccgggaucaggaggggcgcaugaacuacuauuggacacugguugaacccggagacaagauuaccuucgaggccacgggcaaucugguggugccuagauacgcguuugccauggaacggaacgcuggguccggaaucauuaucagcgauacacccgucaaggacugcaacaccacaugucaaaccccuaaaggcgccaucaauaccucucuccccuuccagaacauucauccgaucacaauuggcaagugcccuaaauauguuaagagcacgaaacugcgccuugcuaccgggcugagaaaugugcccuccauccagucucggggacucuuuggcgccauugccggguucaucgagggaggcuggacagggaugguggacggaugguacggcuaucaccaucagaacgaacaaggcagcggguacgcugcggaucugaaguccacccagaaugccaucgacgagauuacaaacaaggucaauagcgugaucgagaaaaugaacacccaguuuacggcuguuggaaaggaguucaaucaccuugagaaacgcauugaaaaccugaauaagaaaguggaugacggcuuccucgauaucuggacauacaacgccgagcugcugguccuccuggaaaaugagagaacccuugacuaucacgauucuaacgugaagaaucuguacgagaagguccggucccagcucaaaaacaacgccaaggaaauugggaauggauguuuugaguucuaucauaaaugcgacaacaccuguauggaaagcgugaagaauggcacauacgauuauccuaaauacucugaggaagcuaagcugaaccgcgaggagaucgacgggguuaaacuugaauccaccagaaucuaucaaauucuggccaucuacagcacaguggcguccucucucguccuggugguuagccugggcgcuauuuccuuuuggaugugcucuaauggaagccuccagugccggaucuguauuuga

SEQ ID NO: 192287 - RNA, 1701 nt, Artificial Sequence
  derived and/or modified sequence opt5 from hemagglutinin__InfluenzaA__AFN18176
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugcucgugccucgguacgcguuugccauggaacgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguaugucaaaucuaccaaacuuagacuggcuacagggcuccggaacauccccagcauucagucccgcggacuguuuggcgccaucgccggguucaucgagggaggcuggaccgggaugguggacggaugguacggcuaucaucaccagaaugaacaaggcucuggguacgcugcggaucuuaagagcacacagaacgccauugacgagaucaccaauaagguuaacuccgugauugagaaaaugaauacgcaguuuacagcugucggaaaggaguucaaccaccuggagaagagaaucgaaaaucucaacaaaaagguggaugacggcuuccuggauauuuggaccuacaaugccgagcugcucguucugcuugaaaacgagcggacccuggacuaucaugauagcaaugugaaaaaccucuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacuuaauagagaggagaucgacggggucaagcuggaaucuacacggauuuaucaaauccucgccauuuacuccacgguggcgagcucccugguucugguggucucucucggcgcuaucagcuuuuggaugugcuccaacggaucucugcagugccgcauuuguaucuga

SEQ ID NO: 192288 - RNA, 1701 nt, Artificial Sequence
  derived and/or modified sequence opt5 from hemagglutinin__InfluenzaA__AFN18183
augaaggccauccuggugguccuccuguacaccuucgcuacagccaacgcggacacgcuuugcauuggcuaucacgcuaauaacagcaccgauacaguugacaccauccuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugaugguuccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugugaaaucuaccaagcugagacuugcuacagggcugcggaacguccccagcauucagucccgcggacucuuuggcgccaucgccggguucaucgagggaggcuggaccgggaugguggacggaugguacggcuaucaucaccagaaugaacaaggcucuggguacgcugcggaucugaaaagcacacagaacgccauugacgagaucaccaauaagguuaacuccgugauugagaaaaugaauacgcaguuuacagcugucggaaaggaguucaaccaccuugagaagagaaucgaaaaucugaacaaaaagguggaugacggcuuccucgauauuuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagaucgacggggucaaacuugaaucuacacggauuuaucaaauccuggccauuuacuccacgguggcgagcucccucguucugguggucucucugggcgcuaucagcuuuuggaugugcuccaacggaucucuccagugccgcauuuguaucuga

SEQ ID NO: 192289 - RNA, 1701 nt, Artificial Sequence; identical to SEQ ID NO: 187245
  derived and/or modified sequence opt5 from hemagglutinin__InfluenzaA__AFN18195

SEQ ID NO: 192290 - RNA, 1701 nt, Artificial Sequence; identical to SEQ ID NO: 185693
  derived and/or modified sequence opt5 from hemagglutinin__InfluenzaA__AFN18200

SEQ ID NO: 192291 - RNA, 1701 nt, Artificial Sequence
  derived and/or modified sequence opt5 from hemagglutinin__InfluenzaA__AFN18207
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagagccugaucuggcucguuaaaaagggcaauuccuacccuaaacugagcaaguccuauauuaacgacaaggggagagaagugcuuguccuguggggaauccaccaccccucuaccagcgccgaucaacagucccucuaccagaaugcugacgccuacguguucgugggcacaagccgguauucuaaaaaguuuaaaccugagauugcuauccgcccgaaggucagagaucaggaggggcggaugaacuacuauuggacccugguugaacccggagacaaaauuacguucgaggccacaggcaaucugguggugccucgcuacgcguuugccauggaaagaaacgcuggguccggaaucauuaucagcgauacccccguccaugacugcaacacaaccugucaaaccccuaagggcgccaucaauacaucucuccccuuccagaacauucacccgaucacgauuggcaaaugcccuaaguauguuaagagcaccaaacugcggcuugcuacagggcugcgcaaugugcccuccauccagucuagaggacucuuuggcgccauugccggguucaucgagggaggcuggaccgggaugguggacggaugguacggcuaucaucaccagaacgaacaaggcagcggguacgcugcggaucugaaguccacacagaaugccaucgacgagauuaccaacaaagucaauagcgugaucgagaagaugaacacgcaguuuacagcuguuggaaaagaguucaaucaccuugagaagcggauugaaaaccugaauaagaaaguggaugacggcuuccucgauaucuggaccuacaacgccgagcugcugguccuccuggaaaaugagcgcacccuugacuaucaugauucuaacgugaagaaucuguacgagaaagucagaucccagcucaagaacaacgccaaagaaauugggaauggauguuuugaguucuaucacaagugcgacaacacauguauggaaagcgugaagaauggcaccuacgauuauccuaaauacucugaggaagcuaagcugaaccgggaggagaucgacgggguuaaacuugaauccacacgcaucuaucaaauucuggccaucuacagcacgguggcguccucucucguccuggugguuagccugggcgcuauuuccuuuuggaugugcucuaauggaagccuccagugcagaaucuguauuuga

SEQ ID NO: 192292 - RNA, 1701 nt, Artificial Sequence
  derived and/or modified sequence opt5 from hemagglutinin__InfluenzaA__AFN18214
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucaauuacgaagaacuccgggagcagcuguccagcgucucuuccuucgaacgcuuugagaucuuccccaagaccagcucuuggccuaaccacgacuccaauaagggagugacagccgcuuguccccaugccggcgcgaaaucuuuuuauaagaaccuuauuuggcugguuaaaaagggcaauagcuacccuaaacucuccaagagcuauaucaacgauaaggggaaagaagugcugguccuuuggggcauucaccaccccuccaccucugccgaccaacagagccuguaccagaaugcugaugccuacguguucgugggauccagcagauauucuaagaaauuuaagccugagaucgcuauucggccgaaaguccgcgaccaggaggggagaaugaacuacuauuggacacucguugaacccggagauaagaucaccuucgaggccacgggcaaccugguggugccucgguacgcguuugccauggaacgcaaugcuggguccggaauuaucaucagcgacacacccguccaugauugcaacaccacaugucaaaccccuaaaggcgccauuaauaccucucugcccuuccagaacauccacccgauuacaaucggcaagugcccuaaguaugugaaaagcacgaagcucagacuggcuaccgggcuucggaauguucccuccauucagucucgcggacuguuuggcgccaucgccggguucaucgagggaggcuggacagggaugguggacggaugguacggcuaucaucaccagaacgaacaaggcagcggguacgcugcggaccucaaauccacccagaaugccauugaugagaucacaaacaaggucaauagcgugauugagaaaaugaacacccaguuuacggcuguuggaaaggaguucaaucaccuggagaagagaaucgaaaaccuuaauaaaaagguggacgauggcuuccuggacauuuggacauacaacgccgagcuccugguccugcucgaaaaugagcggacccuggauuaucaugacucuaacgugaaaaaccuuuacgagaagguccgcucccagcugaaaaauaacgccaaggaaguggggaauggauguuuugaguucuaucacaagugcgauaacaccuguauggaaagcguuaaaaauggcacauacgacuauccuaaguacucugaggaagcuaaacucaacagagaggagaucgauggggugaagcuggaauccacccggaucuaucaaauucuugccaucuacagcacagcggcuuccucucugguccucgugguuagccugggcgccauuuccuuuuggaugugcucuaauggaagccugcagugccgcaucuguauuuga

SEQ ID NO: 192293 - RNA, 1701 nt, Artificial Sequence; identical to SEQ ID NO: 188248
  derived and/or modified sequence opt5 from hemagglutinin__InfluenzaA__AFN18224

SEQ ID NO: 192294 - RNA, 1701 nt, Artificial Sequence; identical to SEQ ID NO: 187245
  derived and/or modified sequence opt5 from hemagglutinin__InfluenzaA__AFN18231

SEQ ID NO: 192295 - RNA, 1701 nt, Artificial Sequence
  derived and/or modified sequence opt5 from hemagglutinin__InfluenzaA__AFN18233
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauucccggaaguuuaaaccggagauugcuauccgccccaaggucagagaucaggaggggcggaugaauuacuauuggacccugguugaaccuggagacaaaauuacguucgaggccacaggcaaccugguggugccccgcuacgcguuugccauggaaagaaacgcugggagcggaaucauuaucucugauaccccuguccaugacugcaauacaaccugucaaacccccaagggcgccaucaacacaucccucccguuccagaauauucacccuaucacgauuggcaaaugccccaaguauguuaagagcaccaaacugcggcuugcuacagggcugcgcaacgugccuucuauccagagcagaggacucuuuggcgccauugccggguucaucgagggaggcuggaccgggaugguggacggaugguacggcuaucaucaccagaaugaacaaggcuccggguacgcugcggaucugaagucuacacagaacgccaucgacgagauuaccaauaaagucaacagcgugaucgagaagaugaauacgcaguuuacagcuguuggaaaagaguucaaccaccuugagaagcggauugaaaaucugaacaagaaaguggaugacggcuuccucgauaucuggaccuacaaugccgagcugcugguccuccuggaaaacgagcgcacccuugacuaucaugauuccaaugugaagaaacuguacgagaaggucagaagccagcucaaaaacaacgccaaggaaauugggaauggauguuuugaguucuaucacaagugcgacaacacauguauggaaucugugaaaaauggcaccuacgauuaucccaaguacuccgaggaagcuaaacugaaccgggaggagaucgacgggguuaaacuugaaagcacacgcaucuaucaaauucuggccaucuacucuacgguggcguccagccucguccuggugguuucccugggcgcuauuucuuuuuggaugugcagcaauggaucccuccagugcagaaucuguauuuga

SEQ ID NO: 192296 - RNA, 1701 nt, Artificial Sequence
  derived and/or modified sequence opt5 from hemagglutinin__InfluenzaA__AFN18243
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 192297 - RNA, 1701 nt, Artificial Sequence; identical to SEQ ID NO: 191782
  derived and/or modified sequence opt5 from hemagglutinin__InfluenzaA__AFN18245

SEQ ID NO: 192298 - RNA, 1701 nt, Artificial Sequence; identical to SEQ ID NO: 188248
  derived and/or modified sequence opt5 from hemagglutinin__InfluenzaA__AFN18255

SEQ ID NO: 192299 - RNA, 1701 nt, Artificial Sequence; identical to SEQ ID NO: 192296
  derived and/or modified sequence opt5 from hemagglutinin__InfluenzaA__AFN18260

SEQ ID NO: 192300 - RNA, 1701 nt, Artificial Sequence; identical to SEQ ID NO: 192296
  derived and/or modified sequence opt5 from hemagglutinin__InfluenzaA__AFN18267

SEQ ID NO: 192301 - RNA, 1701 nt, Artificial Sequence
  derived and/or modified sequence opt5 from hemagglutinin__InfluenzaA__AFN18269
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaaaaguuugagaucuuccccaagaccagcucuuggccuaaucacgauuccaacaaaggagugacagccgcuuguccccaugccggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugccgaucaacagagccucuaccagaacgcugacgccuacguguucgugggcacaucccgcuauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucaugauagcaaugugaagaaccuguacgagaaaguccggucucagcucaagaacaaugccaaggaaauugggaacggauguuuugaguucuaucacaaaugcgacaauacauguauggaauccgugaagaacggcaccuacgauuauccuaaauacagcgaggaagcuaagcugaaucgcgaggagaucgacgggguuaaacuugaaucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 192302 - RNA, 1701 nt, Artificial Sequence; identical to SEQ ID NO: 186857
  derived and/or modified sequence opt5 from hemagglutinin__InfluenzaA__AFN18271

SEQ ID NO: 192303 - RNA, 1701 nt, Artificial Sequence; identical to SEQ ID NO: 187245
  derived and/or modified sequence opt5 from hemagglutinin__InfluenzaA__AFN18273

SEQ ID NO: 192304 - RNA, 1701 nt, Artificial Sequence; identical to SEQ ID NO: 186857
  derived and/or modified sequence opt5 from hemagglutinin__InfluenzaA__AFN18280

SEQ ID NO: 192305 - RNA, 1701 nt, Artificial Sequence; identical to SEQ ID NO: 186491
  derived and/or modified sequence opt5 from hemagglutinin__InfluenzaA__AFN18303

SEQ ID NO: 192306 - RNA, 1701 nt, Artificial Sequence
  derived and/or modified sequence opt5 from hemagglutinin__InfluenzaA__AFN18305
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaggaacugcgggagcagcuuuccagcgugucuuccuucgaacgcuuugagaucuuccccaagaccagcucuuggccuaaucacgauuccaacaagggagucacagcugccuguccccaugcgggcgccaagagcuuuuauaaaaaucugaucuggcucgugaaaaagggcaacucuuacccuaaacuguccaagagcuauauuaaugacaaggggaaagaaguucuugugcuguggggaauccaccaccccuccaccucugcugaucaacagagccucuaccagaacgccgacgcuuacgucuucgugggcacauccagauauagcaagaaauuuaagccugagauugccauccggccgaaagugcgcgaucaggaggggagaaugaauuacuauuggacccuggucgaacccggagacaagauuacguucgaggcgacaggcaaccugguugugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacaagauuaccaauaaagugaacuccgucaucgagaagaugaauacgcaguuuacagccgugggaaaggaguucaaccaccuuggcaaaagaauugaaaaucugaacaagaaaguugaugacggguuccucgauaucuggaccuacaaugccgagcugcuggugcuccuggaaaacgagcggacccuugacuaucaugauagcaaugucaagaaccuguacgaaaaagugcgcucucagcucaagaacaaugcuaaggagauuggaaacggcuguuuugaguucuaucacaaaugcgacaauacauguauggaauccgucaagaacgggaccuacgauuauccuaaauacagcgaggaagccaagcugaauagagaggaaaucgacggcgugaaacuugagucuacacggaucuaucaaauucuggcgaucuacuccacgguugcuagcucccucgugcuggucgugucucugggagccauuagcuuuuggaugugcuccaacggcucucuccagugccgcaucuguauuuga

SEQ ID NO: 192307 - RNA, 1701 nt, Artificial Sequence
  derived and/or modified sequence opt5 from hemagglutinin__InfluenzaA__AFN18307
augaaggccauccuggugguccuccuguacaccuucgcugccgcgaacgcugacacacuuugcauuggcuaucacgccaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacacagggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacaagauuaccaauaaagucaacuccgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauagcaaugugaagaaccuguacgagaaaguccgcucucagcucaagaacaaugccaaggagauugggaacggauguuuugaguucuaucacaaaugcgacaauacauguauggaauccgugaagaacggcaccuacgauuauccuaaauacagcgaagaggcuaagcugaauagagaagagaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 192308 - RNA, 1701 nt, Artificial Sequence
  derived and/or modified sequence opt5 from hemagglutinin__InfluenzaA__AFN18312
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacaagaucaccaauaaagugaacuccgucauugagaagaugaauacgcaguuuacagcugugggaaaggaguucaaccaccuugagaaaagaaucgagaaucugaacaagaaaguugaugacggcuuccucgauauuuggaccuacaaugccgaacugcuggugcuccuggagaacgaacggacccuugacuaucaugauagcaaugucaagaaccuguacgagaaagugcgcucucagcucaagaacaaugccaaggagaucgggaacggauguuuugaguucuaucacaaaugcgacaauacauguauggaauccgucaagaacggcaccuacgauuauccuaaauacagcgaagaggcuaagcugaauagagaagagaucgacggggugaaacuugagucuacacggauuuaucaaauccuggccauuuacuccacgguugcgagcucccucgugcuggucaucucucugggcgcuauuagcuuuuggaugugcuccaacggaucucuccagugccgcaucuguauuuga

SEQ ID NO: 192309 - RNA, 1701 nt, Artificial Sequence; identical to SEQ ID NO: 188058
  derived and/or modified sequence opt5 from hemagglutinin__InfluenzaA__AFN18319

SEQ ID NO: 192310 - RNA, 1701 nt, Artificial Sequence; identical to SEQ ID NO: 190155
  derived and/or modified sequence opt5 from hemagglutinin__InfluenzaA__AFN18324

SEQ ID NO: 192311 - RNA, 1701 nt, Artificial Sequence; identical to SEQ ID NO: 186046
  derived and/or modified sequence opt5 from hemagglutinin__InfluenzaA__AFN18334

SEQ ID NO: 192312 - RNA, 1701 nt, Artificial Sequence; identical to SEQ ID NO: 187809
  derived and/or modified sequence opt5 from hemagglutinin__InfluenzaA__AFN18344

SEQ ID NO: 192313 - RNA, 1701 nt, Artificial Sequence; identical to SEQ ID NO: 185693
  derived and/or modified sequence opt5 from hemagglutinin__InfluenzaA__AFN18354

SEQ ID NO: 192314 - RNA, 1701 nt, Artificial Sequence
  derived and/or modified sequence opt5 from hemagglutinin__InfluenzaA__AFN18364
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucugaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccuccgccgaucaacagucucuguaccagaacgcugacgccuacguguucgugggcacaagcagauauuccaagaaauuuaagccugagauugcuauccggccgaaaguccgcgaucaggaggggagaaugaauuacuauuggacccugguugaacccggagacaagauuacguucgaggccacaggcaaccucguggugccucgguacgcguuugccauggaacgcaacgcugggagcggaaucauuaucucugauacccccguccaugacugcaauacaaccugucaaaccccuaaaggcgccaucaacacaucccugcccuuccagaauauucacccgaucacgauuggcaagugcccuaaguaugugaaaagcaccaaacuuagacuggcuacagggcuccggaacguucccucuauccagagccgcggacuguuuggcgccauugccggguucaucgagggaggcuggaccgggaugguggacggaugguacggcuaucaucaccagaaugaacaaggcuccggguacgcugcggaucuuaagucuacacagaacgccaucgacgagauuaccaauaaggucaacagcgugaucgagaaaaugaauacgcaguuuacagcuguuggaaaggaguucaaccaccuggagaagagaauugaaaaucucaacaaaaagaucgaugacggcuuccuggauauuuggaccuacaaugccgagcugcucgugcugcuugaaaacgagcggacccuggacuaucaugauuccaaugucaaaaaccucuacgagaaggugcgcagccagcugaaaaacaaugccaaggaaaucgggaacggauguuuugaguucuaucacaagugcgacaauacauguauggaaucugucaaaaacggcaccuacgauuauccuaaguacuccgaggaagcuaaacuuaauagagaggagaucgacggggugaagcuggaaagcacacggauuuaucaaauccucgccauuuacucuacgguugcguccagccuggugcuggucgugucccucggcgcuaucucuuuuuggaugugcagcaacggaucccugcagugccgcauuuguaucuga

SEQ ID NO: 192315 - RNA, 1701 nt, Artificial Sequence; identical to SEQ ID NO: 185693
  derived and/or modified sequence opt5 from hemagglutinin__InfluenzaA__AFN18374

SEQ ID NO: 192316 - RNA, 1701 nt, Artificial Sequence
  derived and/or modified sequence opt5 from hemagglutinin__InfluenzaA__AFN18381
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguuaaacccggagacaagauuacguucgaagccacaggcaaccugguggugccuagauacgcguuugccauggagcggaacgcugggucuggaaucauuaucuccgauacccccguccaagacugcaauacaaccugucagaccccuaagggcgccaucaacacaagccuccccuuccagaauauucauccgaucacgauuggcaaaugcccuaaguaugugaaaucuaccaagcugcgccuugcuacagggcugagaaacguucccagcauccagucccggggacucuuuggcgccauugccggguucaucgaaggaggcuggaccgggaugguggacggaugguacggcuaucaccaucaaaaugagcagggcucuggguacgcugcggaucugaaaagcacacagaacgccaucgacgaaauuaccaauaaggucaacuccgugaucgagaagaugaauacgcaguuuacagcuguuggaaaagaguucaaccaccuugaaaagcgcauugagaaucugaacaaaaagguggaugacggcuuccucgauaucuggaccuacaaugccgaacugcugguccuccuggagaacgaaagaacccuugacuaucacgauagcaaugugaaaaaccuguacgagaagguccggucucaacucaagaacaaugccaaagagauugggaacggauguuuugaguucuaucauaagugcgacaauacauguauggaguccgugaaaaacggcaccuacgauuauccuaaguacagcgaagaggcuaaacugaaucgcgaagagaucgacgggguuaaacuugagucuacaagaaucuaucagauucuggccaucuacuccacgguggcgagcucccucguccuggugguuucucugggcgcuauuagcuuuuggaugugcuccaacggaucucuccagugccggaucuguauuuga

SEQ ID NO: 192317 - RNA, 1701 nt, Artificial Sequence
  derived and/or modified sequence opt5 from hemagglutinin__InfluenzaA__AFN18390
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagauucgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 192318 - RNA, 1701 nt, Artificial Sequence
  derived and/or modified sequence opt5 from hemagglutinin__InfluenzaA__AFN18400
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguuacaccccuccaucugggcaaaugcaacaucgccggguggauucugggaaauccugagugugaaucucucagcaaggccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaaaggagugacagcugccuguccccaugcuggcgccaagagcuuuuauaaaaaucugaucuggcucguuaagaaaggcaacucuuacccuaagcuguccaagagcuauauuaaugacaaagggaaggaagugcuuguccuguggggaauccaccaccccuccaccucugcggaucaacagagccucuaccagaacgccgacgcuuacguguucgugggcacauccagauauagcaaaaaguuuaaaccugagauugccauccggccgaagguccgcgaucaggaggggagaaugaauuacuauuggacccugguugaacccggagacaaaauuacguucgaggcuacaggcaaccugguggugccucgguacgccuuugcgauggaacgcaacgucgggucuggaaucauuaucuccgauacccccgugcaugacugcaauacaaccugucaaaccccuaagggcgccaucaacacaagccuccccuuccagaauauucacccgaucacgauuggcaagugcccuaaauauguuaagucuaccaaacugagacuugcuacagggcugcggaacgugcccagcauccagucccgcggacucuuuggcgccauugcuggguucaucgagggaggcuggaccgggauggucgacggaugguacggcuaucaucaccagaaugaacaaggcucuggguacgccgccgaucuuaagagcacacagaacgcuaucgacgagauuaccaauaaagugaacuccguuaucgagaagaugaauacgcaguuuacagcggugggaaaggaguucaaccaccuggagaaaagaauugaaaaucugaacaagaaagucgaugacggcuuccucgauaucuggaccuacaaugccgagcugcuggugcuccuggaaaacgagcggacccuugacuaucaugauagcaaugucaagaaccuguacgagaaagugcgcucucagcucaagaacaaugcuaaggaaauugggaacggauguuuugaguucuaucacaaaugcgacaauacauguauggaauccguuaagaacggcaccuacgauuauccuaaauacagcgaggaagccaagcugaauagagaggagaucgacggggugaaacuugaaucuacacggaucuaucaaauucuggccaucuacuccacggucgcuagcucccucgugcugguugugucucugggcgccauuagcuuuuggaugugcuccaacggaucucuccagugccgcaucuguauuuga

SEQ ID NO: 192319 - RNA, 1701 nt, Artificial Sequence; identical to SEQ ID NO: 185784
  derived and/or modified sequence opt5 from hemagglutinin__InfluenzaA__AFN18410

SEQ ID NO: 192320 - RNA, 1701 nt, Artificial Sequence; identical to SEQ ID NO: 185693
  derived and/or modified sequence opt5 from hemagglutinin__InfluenzaA__AFN18420

SEQ ID NO: 192321 - RNA, 1701 nt, Artificial Sequence
  derived and/or modified sequence opt5 from hemagglutinin__InfluenzaA__AFN18430
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaaaauaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccaugguccgcaaugcugggucuggaaucauuaucuccgacacccccgugcaugauugcaacacaaccugucaaaccccuaaaggcgccaucaauacaagccuccccuuccagaacauucacccgaucacgauuggcaagugcccuaaguauguuaaaucuaccaagcugagacuugcuacagggcugcggaaugugcccagcauccagucccgcggacucuuuggcgccauugccggguucaucgaaggaggcuggaccgggauggucgacggaugguacggcuaucaucaccagaacgagcaaggcucuggguacgcugcggaccugaaaagcacacagaaugccaucgaugaaauuaccaacaaggugaauagcguuaucgagaaaaugaacacgcaguuuacagcugugggaaaggaguucaaucaccuugaaaagagaauugagaaccugaauaaaaaggucgacgauggcuuccucgacaucuggaccuacaacgccgaacugcuggugcuccuggagaaugaacggacccuugauuaucaugacagcaacgucaaaaaccuguacgagaaggugcgcucucagcucaaaaauaacgccaaggagauugggaauggauguuuugaguucuaucacaagugcgauaacacauguauggaguccguuaaaaauggcaccuacgacuauccuaaguacagcgaagaggcuaaacugaacagagaagagaucgauggggugaaacuugagucuacacggaucuaucaaauucuggccaucuacuccacggucgcgagcucccucgugcugguugugucucugggcgcuauuagcuuuuggaugugcuccaauggaucucuccagugccgcaucuguauuuga

SEQ ID NO: 192322 - RNA, 1701 nt, Artificial Sequence; identical to SEQ ID NO: 185693
  derived and/or modified sequence opt5 from hemagglutinin__InfluenzaA__AFN18440

SEQ ID NO: 192323 - RNA, 1701 nt, Artificial Sequence; identical to SEQ ID NO: 185693
  derived and/or modified sequence opt5 from hemagglutinin__InfluenzaA__AFN18450

SEQ ID NO: 192324 - RNA, 1701 nt, Artificial Sequence; identical to SEQ ID NO: 188248
  derived and/or modified sequence opt5 from hemagglutinin__InfluenzaA__AFN18460

SEQ ID NO: 192325 - RNA, 1701 nt, Artificial Sequence; identical to SEQ ID NO: 186554
  derived and/or modified sequence opt5 from hemagglutinin__InfluenzaA__AFN18470

SEQ ID NO: 192326 - RNA, 1701 nt, Artificial Sequence; identical to SEQ ID NO: 185784
  derived and/or modified sequence opt5 from hemagglutinin__InfluenzaA__AFN18480

SEQ ID NO: 192327 - RNA, 1701 nt, Artificial Sequence; identical to SEQ ID NO: 186554
  derived and/or modified sequence opt5 from hemagglutinin__InfluenzaA__AFN18490

SEQ ID NO: 192328 - RNA, 1701 nt, Artificial Sequence; identical to SEQ ID NO: 185693
  derived and/or modified sequence opt5 from hemagglutinin__InfluenzaA__AFN18497

SEQ ID NO: 192329 - RNA, 1701 nt, Artificial Sequence; identical to SEQ ID NO: 185693
  derived and/or modified sequence opt5 from hemagglutinin__InfluenzaA__AFN18512

SEQ ID NO: 192330 - RNA, 1701 nt, Artificial Sequence
  derived and/or modified sequence opt5 from hemagglutinin__InfluenzaA__AFN18519
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaaggaaaacagcuacccuaaacuguccaagagcuauauuaaugacaagggcaaagaggugcuuguccugugggggauccaccaccccuccaccucugccgaucaacagagccucuaccagaacgcugacgccuacguguucgugggaacauccagauauagcaagaaauuuaagccugagauugcuauccggccgaaaguccgcgaucaggaaggcagaaugaauuacuauuggacccugguugagcccggggacaagauuacguucgaagccacaggaaaccugguggugccucgguacgcguuugccauggagcgcaacgcuggcucugggaucauuaucuccgauacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggacgggugguacggauaucaucaccagaaugagcaaggcucuggcuacgcugcggaucugaaaagcacacagaacgccaucgacgagauuaccaauaaggucaacuccgugaucgaaaagaugaauacgcaguuuacagcuguugggaaggaguucaaccaccuugaaaagagaauugagaaucugaacaaaaagguggaugacggauuccucgauaucuggaccuacaaugccgaacugcugguccuccuggagaacgagcggacccuugacuaucaugauagcaaugugaaaaaccuguacgaaaagguccgcucucagcucaaaaacaaugccaaggagauuggcaacggguguuuugaguucuaucacaagugcgacaauacauguauggaguccgugaaaaacggaaccuacgauuauccuaaguacagcgaagaggcuaaacugaauagagaggaaaucgacggcguuaaacuugagucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 192331 - RNA, 1701 nt, Artificial Sequence
  derived and/or modified sequence opt5 from hemagglutinin__InfluenzaA__AFN18521
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacagaacgccaucgacgaaauuaccaauaaggugaacuccguuaucgagaaaaugaauacgcaguuuacagcugugggaaaggaguucaaccaccuugaaaagagaauugagaaucugaacaaaaaggucgaugacggcuuccucgauaucuggaccuacaaugccgaacugcuggugcuccuggagaacgaacggacccuugacuaucaugauagcaaugucaaaaaccuguacgagaaggugcgcucucagcucaaaaacaaugccaaggagauugggaacggauguuuugaguucuaucacaagugcgacaauacauguauggaguccguuaaaaacggcaccuacgauuauccuaaguacagcggggaagcuaaacugaauagagaggaaaucgacggcgugaaacuugagucuacacggaucuaucaaauucuggccaucuacuccacggucgcgagcucccucgugcugguugugucucugggagcuauuagcuuuuggaugugcuccaacggcucucuccagugccgcaucuguauuuga

SEQ ID NO: 192332 - RNA, 1701 nt, Artificial Sequence; identical to SEQ ID NO: 185693
  derived and/or modified sequence opt5 from hemagglutinin__InfluenzaA__AFN18528

SEQ ID NO: 192333 - RNA, 1701 nt, Artificial Sequence; identical to SEQ ID NO: 185693
  derived and/or modified sequence opt5 from hemagglutinin__InfluenzaA__AFN18531

SEQ ID NO: 192334 - RNA, 1701 nt, Artificial Sequence; identical to SEQ ID NO: 188290
  derived and/or modified sequence opt5 from hemagglutinin__InfluenzaA__AFN18543

SEQ ID NO: 192335 - RNA, 1701 nt, Artificial Sequence; identical to SEQ ID NO: 190575
  derived and/or modified sequence opt5 from hemagglutinin__InfluenzaA__AFN18545

SEQ ID NO: 192336 - RNA, 1701 nt, Artificial Sequence; identical to SEQ ID NO: 186554
  derived and/or modified sequence opt5 from hemagglutinin__InfluenzaA__AFN18550

SEQ ID NO: 192337 - RNA, 1701 nt, Artificial Sequence
  derived and/or modified sequence opt5 from hemagglutinin__InfluenzaA__AFN18557
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccgcccaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 192338 - RNA, 1701 nt, Artificial Sequence
  derived and/or modified sequence opt5 from hemagglutinin__InfluenzaA__AFN18559
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagaaccucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 192339 - RNA, 1701 nt, Artificial Sequence; identical to SEQ ID NO: 186559
  derived and/or modified sequence opt5 from hemagglutinin__InfluenzaA__AFN18561

SEQ ID NO: 192340 - RNA, 1701 nt, Artificial Sequence; identical to SEQ ID NO: 186795
  derived and/or modified sequence opt5 from hemagglutinin__InfluenzaA__AFN18563

SEQ ID NO: 192341 - RNA, 1701 nt, Artificial Sequence
  derived and/or modified sequence opt5 from hemagglutinin__InfluenzaA__AFN18565
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacagaacgccaucgacgaaauuaccaauaaggugaacuccguuaucgagaaaaugaauacgcaguuuacagcugugggaaaggaguucaaccaccuugaaaagagaauggagaaucugaacaaaaaggucgaugacggcuuccucgauauuuggaccuacaaugccgaacugcuggugcuccuggagaacgaacggacccuugacuaucaugauagcaaugucaaaaaccuguacgagaaggugcgcucucagcucaaaaacaaugccaaggagaucgggaacggauguuuugaguucuaucacaagugcgacaauacauguauggaguccguuaaaaacggcaccuacgauuauccuaaguacagcgaagaggcuaaacugaauagagaagagauugacggggugaaacuugagucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 192342 - RNA, 1701 nt, Artificial Sequence
  derived and/or modified sequence opt5 from hemagglutinin__InfluenzaA__AFN18570
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaguguccucuuggagcuacaucgucgagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgauuccaacaagggaguuacagccgccuguccccaugcuggcgccaagagcuuuuauaagaaucugaucuggcucgugaaaaagggcaacucuuacccuaaacuguccaagagcuauauuaaugacaaggggaaagaaguccuugugcuguggggaauccaccaccccuccaccucugcggaucaacagagccucuaccagaacgccgacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacgagauuaccaauaaggugaacuccguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccguuaaaaacggcaccuacgauuauccuaaguacagcgaggaagccaaacugaauagagaggagaucgacggggugaaacuugaaucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 192343 - RNA, 1701 nt, Artificial Sequence; identical to SEQ ID NO: 185693
  derived and/or modified sequence opt5 from hemagglutinin__InfluenzaA__AFN18580

SEQ ID NO: 192344 - RNA, 1701 nt, Artificial Sequence; identical to SEQ ID NO: 185935
  derived and/or modified sequence opt5 from hemagglutinin__InfluenzaA__AFN18590

SEQ ID NO: 192345 - RNA, 1701 nt, Artificial Sequence
  derived and/or modified sequence opt5 from hemagglutinin__InfluenzaA__AFN18600
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagaaccucuaccagaaugcugacgccuacguguucgugggcacaagcagauauuccaagaaauuuaagccugagauugcuauccggccgaaaguccgcgaucaggaggggagaaugaacuacuauuggacccugguugaacccggagacaagauuacguucgaggccacaggcaaccugguggugccucgguacgcguuugccauggaacgcaaugcugggagcggaaucauuaucucugauacccccguccaugacugcaacacaaccugucaaaccccuaaaggcgccaucaauacaucccuccccuuccagaacauucacccgaucacgauuggcaagugcccuaaguaugugaaaagcaccaagcugagacuugcuacagggcugcggaauguucccucuauccagagccgcggacucuuuggcgccauugccggguucaucgagggaggcuggaccgggaugguggacggaugguacggcuaucaucaccagaacgaacaaggcuccggguacgcugcggaucugaaaucuacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauuccaacgugaaaaaccuguacgagaagguccgcagccagcucaaaaauaacgccaaggaaauugggaauggauguuuugaguucuaucacaagugcgacaacgcuuguauggaaucugugaaaaauggcacauacgauuauccuaaguacuccgaggaagccaaacugaacagagaggagaucgacgggguuaaacuugaaagcacccggaucuaucaaauucuggcgaucuacucuacaguggcuuccagccucguccuggugguuucccugggcgccauuucuuuuuggaugugcagcaauggaucccuccagugccgcaucuguauuuga

SEQ ID NO: 192346 - RNA, 1701 nt, Artificial Sequence; identical to SEQ ID NO: 185693
  derived and/or modified sequence opt5 from hemagglutinin__InfluenzaA__AFN18610

SEQ ID NO: 192347 - RNA, 1701 nt, Artificial Sequence
  derived and/or modified sequence opt5 from hemagglutinin__InfluenzaA__AFN18617
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacaguccgccaucgacgaaauuaccaacaaggugaauagcguuaucgagaaaaugaacacgcaguuuacagcugugggaaaggaguucaaucaccuugaaaagagaauugagaaccugaauaaaaaggucgaugacggcuuccucgauaucuggaccuacaacgccgaacugcuggugcuccuggagaaugaacggacccuugacuaucaugauucuaacgucaaaaaucuguacgagaaggugcgcucccagcucaaaaacaacgccaaggagauugggaauggauguuuugaguucuaucacaagugcgacaacacauguauggagagcguuaaaaauggcaccuacgauuauccuaaguacucugaagaggcuaaacugaagagagaagagaucgacggggugaaacuugaguccacacggaucuaucaaauucuggccaucuacagcacggucgcguccucucucgugcugguugugagccugggcgcuauuuccuuuuggaugugcucuaacggaagccuccagugccgcaucuguauuuga

SEQ ID NO: 192348 - RNA, 1701 nt, Artificial Sequence; identical to SEQ ID NO: 186554
  derived and/or modified sequence opt5 from hemagglutinin__InfluenzaA__AFN18622

SEQ ID NO: 192349 - RNA, 1701 nt, Artificial Sequence; identical to SEQ ID NO: 185693
  derived and/or modified sequence opt5 from hemagglutinin__InfluenzaA__AFN18629

SEQ ID NO: 192350 - RNA, 1701 nt, Artificial Sequence; identical to SEQ ID NO: 185935
  derived and/or modified sequence opt5 from hemagglutinin__InfluenzaA__AFN18634

SEQ ID NO: 192351 - RNA, 1701 nt, Artificial Sequence
  derived and/or modified sequence opt5 from hemagglutinin__InfluenzaA__AFN18644
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacaguccgccaucgacgaaauuaccaacaaggugaauagcguuaucgagaaagugaacacgcaguuuacagcugucggaaaggaguucaaucaccuugaaaagagaauugagaaccugaauaaaaagguggaugacggcuuccucgauaucuggaccuacaacgccgaacugcugguccuccuggagaaugaacggacccuugacuaucaugauucuaacgugaaaaaucuguacgagaagguucgcucccagcucaaaaacaacgccaaggagauugggaauggauguuuugaguucuaucacaagugcgacaacacauguauggagagcgugaaaaauggcaccuacgauuauccuaaguacucugaagaggcuaaacugaacagagaagagaucgacggggucaaacuugaguccacacggaucuaucaaauucuggccaucuacagcacgguggcguccucucucguucugguggucagccugggcgcuauuuccuuuuggaugugcucuaauggaagccuccagugccgcaucuguauuuga

SEQ ID NO: 192352 - RNA, 1701 nt, Artificial Sequence; identical to SEQ ID NO: 186554
  derived and/or modified sequence opt5 from hemagglutinin__InfluenzaA__AFN18654

SEQ ID NO: 192353 - RNA, 1701 nt, Artificial Sequence; identical to SEQ ID NO: 185693
  derived and/or modified sequence opt5 from hemagglutinin__InfluenzaA__AFN18664

SEQ ID NO: 192354 - RNA, 1701 nt, Artificial Sequence; identical to SEQ ID NO: 185935
  derived and/or modified sequence opt5 from hemagglutinin__InfluenzaA__AFN18674

SEQ ID NO: 192355 - RNA, 1701 nt, Artificial Sequence; identical to SEQ ID NO: 185693
  derived and/or modified sequence opt5 from hemagglutinin__InfluenzaA__AFN18684

SEQ ID NO: 192356 - RNA, 1701 nt, Artificial Sequence; identical to SEQ ID NO: 186554
  derived and/or modified sequence opt5 from hemagglutinin__InfluenzaA__AFN18694

SEQ ID NO: 192357 - RNA, 1701 nt, Artificial Sequence
  derived and/or modified sequence opt5 from hemagglutinin__InfluenzaA__AFN18704
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacaguccgccaucgacgaaauuaccaacaaggugaauagcguuaucgagaaaaugaacacgcaguuuacagcugugggaaaggaguucaaucaccuugaaaagagaauugagaaccugaauaaaaaggucgaugacggcuuccucgauaucuggaccuacaacgccgaacugcuggugcuccuggagaaugaacggacccuugacuaucaugauucuaacgucaaaaaucuguacgagaaggugcgcucccagcucaaaaacaacgccaaggagauugggaauggauguuuugaguucuaucacaagugcgacaacacauguauggagagcguuaaaaauggcaccuacgauuauccuaaguacucugaagaggcuaaacugaacagagaagagaucgacggggugaaacuugaguccacacggaucuaucaaauucuggccaucuacagcacggucgcguccucucucgugcugguugugagccugggcgcuauuuccuuuuggaugugcucuaauggaagccuccagugccgcaucuguauuuga

SEQ ID NO: 192358 - RNA, 1701 nt, Artificial Sequence; identical to SEQ ID NO: 187927
  derived and/or modified sequence opt5 from hemagglutinin__InfluenzaA__AFN18714

SEQ ID NO: 192359 - RNA, 1701 nt, Artificial Sequence; identical to SEQ ID NO: 185693
  derived and/or modified sequence opt5 from hemagglutinin__InfluenzaA__AFN18721

SEQ ID NO: 192360 - RNA, 1701 nt, Artificial Sequence; identical to SEQ ID NO: 188359
  derived and/or modified sequence opt5 from hemagglutinin__InfluenzaA__AFN18725

SEQ ID NO: 192361 - RNA, 1701 nt, Artificial Sequence
  derived and/or modified sequence opt5 from hemagglutinin__InfluenzaA__AFN18735
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagacccugaucuggcucguuaaaaagggcaauagcuacccuaaacuguccaagagcuauauuaacgacaaggggaaagaagugcuuguccuguggggaauccaccaccccuccacaucugccgaucaacagagccucuaccagaaugcugacgccuacguguucgugggcaccuccagauauagcaagaaauuuaagccugagauugcuauccggccgaaaguccgcgaucaggaggggagaaugaacuacuauuggacgcugguugaacccggagacaagauuacauucgaggccaccggcaaucugguggugccucgguacgcguuugccauggaacgcaacgcugggucuggaaucauuaucuccgauacacccguccaugacugcaacaccaccugucaaacaccuaaaggcgccaucaauacgagccuccccuuccagaacauucacccgaucaccauuggcaagugcccuaaguaugugaaaucuacaaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacgaacaaggucaauuccgugaucgagaaaaugaacacacaguuuaccgcuguuggaaaggaguucaaucaccuugagaagagaauugaaaaccugaauaaaaagguggaugacggcuuccucgauaucuggaccuacaacgccgagcugcugguccuccuggaaaaugagcggacacuugacuaucaugauagcaacgugaaaaaucuguacgagaagguccgcucucagcucaaaaacaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacgcggaucuaucaaauucuggccaucuacuccaccguggcgagcucccucguccuggugguuucucugggcgcuauuagcuuuuggaugugcuccaauggaucucuccagugccgcaucuguauuuga

SEQ ID NO: 192362 - RNA, 1701 nt, Artificial Sequence; identical to SEQ ID NO: 185693
  derived and/or modified sequence opt5 from hemagglutinin__InfluenzaA__AFN18742

SEQ ID NO: 192363 - RNA, 1701 nt, Artificial Sequence; identical to SEQ ID NO: 186795
  derived and/or modified sequence opt5 from hemagglutinin__InfluenzaA__AFN18747

SEQ ID NO: 192364 - RNA, 1701 nt, Artificial Sequence
  derived and/or modified sequence opt5 from hemagglutinin__InfluenzaA__AFN18757
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccuggcggugccucgguacgccuuugcuauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguaugucaaaucuaccaagcugagacuugccacagggcugcggaacgugcccagcauccagucccgcggacucuuuggcgccauugcuggguucaucgagggaggcuggaccgggaugguugacggaugguacggcuaucaucaccagaaugaacaaggcucuggguacgcggccgaucugaaaagcacacagaacgcuaucgacgagauuaccaauaaggugaacuccgucaucgagaaaaugaauacgcaguuuacagccgugggaaaggaguucaaccaccuugagaagagaauugaaaaucugaacaaaaagguugaugacggcuuccucgauaucuggaccuacaaugccgagcugcuggugcuccuggaaaacgagcggacccuugacuaucaugauagcaaugucaaaaaccuguacgagaaggugcgcucucagcucaaaaacaaugcuaaggaaauugggaacggauguuuugaguucuaucacaagugcgacaauacauguauggaauccgucaaaaacggcaccuacgauuauccuaaguacagcgaggaagccaaacugaauagagaggagaucgacggggugaaacuugaaucuacacggaucuaucaaauucuggcgaucuacuccacgguugcuagcucccucgugcuggucgugucucugggcgccauuagcuuuuggaugugcuccaacggaucucuccagugccgcaucuguauuuga

SEQ ID NO: 192365 - RNA, 1701 nt, Artificial Sequence; identical to SEQ ID NO: 185693
  derived and/or modified sequence opt5 from hemagglutinin__InfluenzaA__AFN18767

SEQ ID NO: 192366 - RNA, 1701 nt, Artificial Sequence; identical to SEQ ID NO: 192357
  derived and/or modified sequence opt5 from hemagglutinin__InfluenzaA__AFN18774

SEQ ID NO: 192367 - RNA, 1701 nt, Artificial Sequence; identical to SEQ ID NO: 185693
  derived and/or modified sequence opt5 from hemagglutinin__InfluenzaA__AFN18776

SEQ ID NO: 192368 - RNA, 1701 nt, Artificial Sequence; identical to SEQ ID NO: 186559
  derived and/or modified sequence opt5 from hemagglutinin__InfluenzaA__AFN18778

SEQ ID NO: 192369 - RNA, 1701 nt, Artificial Sequence; identical to SEQ ID NO: 185693
  derived and/or modified sequence opt5 from hemagglutinin__InfluenzaA__AFN18784

SEQ ID NO: 192370 - RNA, 1701 nt, Artificial Sequence; identical to SEQ ID NO: 186559
  derived and/or modified sequence opt5 from hemagglutinin__InfluenzaA__AFN18789

SEQ ID NO: 192371 - RNA, 1701 nt, Artificial Sequence; identical to SEQ ID NO: 185693
  derived and/or modified sequence opt5 from hemagglutinin__InfluenzaA__AFN18799

SEQ ID NO: 192372 - RNA, 1701 nt, Artificial Sequence; identical to SEQ ID NO: 185693
  derived and/or modified sequence opt5 from hemagglutinin__InfluenzaA__AFN18809

SEQ ID NO: 192373 - RNA, 1701 nt, Artificial Sequence; identical to SEQ ID NO: 186795
  derived and/or modified sequence opt5 from hemagglutinin__InfluenzaA__AFN18816

SEQ ID NO: 192374 - RNA, 1701 nt, Artificial Sequence; identical to SEQ ID NO: 185693
  derived and/or modified sequence opt5 from hemagglutinin__InfluenzaA__AFN18818

SEQ ID NO: 192375 - RNA, 1701 nt, Artificial Sequence
  derived and/or modified sequence opt5 from hemagglutinin__InfluenzaA__AFN18820
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaacugcaauaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaaaaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 192376 - RNA, 1701 nt, Artificial Sequence; identical to SEQ ID NO: 185693
  derived and/or modified sequence opt5 from hemagglutinin__InfluenzaA__AFN18822

SEQ ID NO: 192377 - RNA, 1701 nt, Artificial Sequence
  derived and/or modified sequence opt5 from hemagglutinin__InfluenzaA__AFN18824
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguucggcuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 192378 - RNA, 1701 nt, Artificial Sequence; identical to SEQ ID NO: 192301
  derived and/or modified sequence opt5 from hemagglutinin__InfluenzaA__AFN18826

SEQ ID NO: 192379 - RNA, 1701 nt, Artificial Sequence
  derived and/or modified sequence opt5 from hemagglutinin__InfluenzaA__AFN18828
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaucaagcugagacuugcuaccgggcugcggaacguucccagcauucagucccgcggacucuuuggcgccaucgccggguucaucgagggaggcuggacagggaugguggacggaugguacggcuaucaucaccagaaugaacaaggcucuggguacgcugcggaucugaaaagcacccagaacgccauugacgagaucacaaauaaggucaacuccgugauugagaaaaugaauacccaguuuacggcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 192380 - RNA, 1701 nt, Artificial Sequence; identical to SEQ ID NO: 192364
  derived and/or modified sequence opt5 from hemagglutinin__InfluenzaA__AFN18830

SEQ ID NO: 192381 - RNA, 1701 nt, Artificial Sequence; identical to SEQ ID NO: 185693
  derived and/or modified sequence opt5 from hemagglutinin__InfluenzaA__AFN18832

SEQ ID NO: 192382 - RNA, 1701 nt, Artificial Sequence; identical to SEQ ID NO: 186559
  derived and/or modified sequence opt5 from hemagglutinin__InfluenzaA__AFN18834

SEQ ID NO: 192383 - RNA, 1701 nt, Artificial Sequence
  derived and/or modified sequence opt5 from hemagglutinin__InfluenzaA__AFN18849
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacguggacgcuuacguguucgucggcacauccagauauagcaagaaauuuaagccugagauugccauccggccgaaaguucgcgaucaggaggggagaaugaauuacuauuggacccugguggaacccggagacaagauuacguucgaggcuacaggcaaccugguggucccucgguacgccuuugcgauggaacgcaacgccgggucuggaaucauuaucuccgauacccccgugcaugacugcaauacaaccugucaaaccccuaaaggcgcuaucaacacaagccuccccuuccagaauauucacccgaucacgauuggcaagugcccuaaguauguuaaaucuaccaagcugagacuugccacagggcugcggaacgugcccagcauccagucccgcggacucuuuggcgcuauugccggguucaucgagggaggcuggaccgggauggucgacggaugguacggcuaucaucaccagaaugaacaaggcucuggguacgccgcugaucugaaaagcacacagaacgcgaucgacgagauuaccaauaaggugaacuccguuaucgagaaaaugaauacgcaguuuacagccgugggaaaggaguucaaccaccuugagaagagaauugaaaaucugaacaaaaaggucgaugacggcuuccucgauaucuggaccuacaaugcugagcugcuggugcuccuggaaaacgagcggacccuugacuaucaugauagcaaugucaaaaaccuguacgagaaggugcgcucucagcucaaaaacaaugccaaggaaauugggaacggauguuuugaguucuaucacaagugcgacaauacauguauggaauccguuaaaaacggcaccuacgauuauccuaaguacagcgaggaagccaaacugaauagagaggagaucgacggggugaaacuugaaucuacacggaucuaucaaauucuggcuaucuacuccacggucgccagcucccucgugcugguugugucucugggcgcgauuagcuuuuggaugugcuccaacggaucucuccagugccgcaucuguauuuga

SEQ ID NO: 192384 - RNA, 1701 nt, Artificial Sequence
  derived and/or modified sequence opt5 from hemagglutinin__InfluenzaA__AFN18856
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaaaauaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 192385 - RNA, 1701 nt, Artificial Sequence; identical to SEQ ID NO: 186554
  derived and/or modified sequence opt5 from hemagglutinin__InfluenzaA__AFN18858

SEQ ID NO: 192386 - RNA, 1701 nt, Artificial Sequence
  derived and/or modified sequence opt5 from hemagglutinin__InfluenzaA__AFN18860
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgaucaggaggggagaauggacuacuauuggacccugguugaaccgggagauaagauuacguucgaggccacaggcaaucugguggugccccgguacgcguuugccauggaacgcaacgcuggguccggaaucauuaucagcgacaccccuguccaugacugcaacacaaccugucaaacccccaaaggcgccaucaauacaucucucccuuuccagaacauucaccccaucacgauuggcaagugcccgaaguaugugaaaagcaccaagcugagacuugcuacagggcugcggaauguuccuuccauccagucucgcggacucuuuggcgccauugccggguucaucgagggaggcuggaccgggaugguggauggaugguacggcuaucaucaccagaacgaacaaggcagcggguacgcugcggaccugaaauccacacagaaugccaucgaugagauuaccaacaaggucaauagcgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacacauguauggaaagcgugaaaaauggcaccuacgacuaucccaaguacucugaggaagcuaaacugaacagagaggagaucgaugggguuaaacuugaauccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 192387 - RNA, 1701 nt, Artificial Sequence
  derived and/or modified sequence opt5 from hemagglutinin__InfluenzaA__AFN18865
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauaccagcguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacaagauuaccaauaaagucaacagcgugaucgagaagaugaauacgcaguuuacagcuguuggaaaggaguucaaccaccuugagaaaagaauugagaaucugaacaagaaaguggaugacggcuuccucgauaucuggaccuacaaugccgaacugcugguccuccuggagaacgaacggacccuugacuaucaugauucuaaugugaagaaccuguacgagaaaguccgcucccagcucaagaacaaugccaaggagauugggaacggauguuuugaguucuaucacaaaugcgacaauacauguauggaaagcgugaagaacggcaccuacgauuaucccaaauacucugaagaggcuaagcugaauagagaagagaucgacgggguuaaacuugaguccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 192388 - RNA, 1701 nt, Artificial Sequence
  derived and/or modified sequence opt5 from hemagglutinin__InfluenzaA__AFN18875
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgcucaacagagccucuaccagaacgccgaugcuuacguguucgugggcuccagcagauauucuaaaaaguuuaaaccugagauugccauccggccgaagguccgcgaccaggaagggagaaugaauuacuauuggacacugguugagcccggagauaaaauuaccuucgaagcgacgggcaaccugguggugccucgguacgccuuugcuauggagcgcaacgccggguccggaaucauuaucagcgacacacccguccaugauugcaauaccacaugucaaaccccuaagggcgcuaucaacaccucucuccccuuccacaauauucauccgaucacaauuggcaaaugcccuaaguauguuaagagcacgaaacugagacuugccaccgggcugcggaacgugcccuccauccagucucgcggacucuuuggcgccauugcuggguucaucgaaggaggcuggacagggaugguggacggaugguacggcuaucaccaccagaaugagcagggcagcggguacgcggccgaccugaaguccacccaaaacgcuaucgaugagauuacaaauaaagucaacagcgugaucgaaaagaugaauacccaguuuacggccguuggaaaagaguucaaccaucuugaaaagagaauugagaaucugaacaagaaaguggacgauggcuuccucgacaucuggacauacaaugccgaacugcugguccuccuggagaacgagcggacccuugauuaucacgacucuaaugugaagaaccuguacgaaaaaguccgcucccagcucaagaacaaugcuaaagagauugggaacggauguuuugaguucuaucauaagugcgauaauaccuguauggaaagcgugaagaacggcacauacgacuauccuaaauacucugaagaggccaagcugaauagagaggaaaucgaugggguuaaacuugaguccacccggaucuaucagauucuggcgaucuacagcacaguggcuuccucucucguccuggugguuagccugggcgccauuuccuuuuggaugugcucuaacggaagccuccaaugccgcaucuguauuuga

SEQ ID NO: 192389 - RNA, 1701 nt, Artificial Sequence
  derived and/or modified sequence opt5 from hemagglutinin__InfluenzaA__AFN18885
augaaggccauccugauugugcuccuguacaccuucgcuacagccaacgcggacacgcuuugcaucggcuaucacgcuaauaacagcaccgauacagucgacaccguucuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaaaucuccccuuccagaacauccacccgauuacgaucggcaagugcccuaaguaugucaaaagcaccaagcugagacuugcuacagggcugcggaaugugcccucuacccagagccgcggacucuuuggcgccauugccggguucaucgagggaggcuggacagggaugguugacggaugguacggcuaucaucaccagaacgaacaaggcuccggguacgcugcggaucugaaaucuacccagaaugccaucgacgagauuacgaacaaggugaauagcgucaucgagaaaaugaacacacaguuuaccgcugugggaaaggaguucaaucaccuugagaagagaauugaaaaccugaauaaaaagguugaugacggcuuccucgauaucuggaccuacaacgccgagcugcuggugcuccuggaaaaugagcggacacuugacuaucaugauuccaacgucaaaaaccuguacgagaaggugcgcagccagcucaaaaauaacgccaaggaaauugggaauggauguuuugaguucuaucacaagugcgacaacaccuguauggaaucugucaaaaauggcacauacgauuauccuaaguacuccgaggaagcuaaacugaacagagaggagaucgacggggugaaacuugaaagcacgcggaucuaucaaauucuggccaucuacucuaccguugcguccagccucgugcuggucgugucccugggcgcuauuucuuuuuggaugugcagcaauggaucccuccagugcaagaucuguauuuga

SEQ ID NO: 192390 - RNA, 1701 nt, Artificial Sequence; identical to SEQ ID NO: 185693
  derived and/or modified sequence opt5 from hemagglutinin__InfluenzaA__AFN18892

SEQ ID NO: 192391 - RNA, 1701 nt, Artificial Sequence; identical to SEQ ID NO: 185935
  derived and/or modified sequence opt5 from hemagglutinin__InfluenzaA__AFN18894

SEQ ID NO: 192392 - RNA, 1701 nt, Artificial Sequence; identical to SEQ ID NO: 192357
  derived and/or modified sequence opt5 from hemagglutinin__InfluenzaA__AFN18903

SEQ ID NO: 192393 - RNA, 1701 nt, Artificial Sequence; identical to SEQ ID NO: 186795
  derived and/or modified sequence opt5 from hemagglutinin__InfluenzaA__AFN18910

SEQ ID NO: 192394 - RNA, 1701 nt, Artificial Sequence
  derived and/or modified sequence opt5 from hemagglutinin__InfluenzaA__AFN18912
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacaucuguccaugacugcaauaccacaugucaaacccccaagggcgccaucaacaccagccucccuuuccacaauauucaucccaucacaauuggcaaaugcccgaaguaugugaaguccacgaaacugagacuugcuaccgggcugcggaacguuccuucuauccagagccgcggacucuuuggcgccauugccggguucaucgaaggaggcuggacagggaugguggacggaugguacggcuaucaccaccagaaugagcagggcuccggguacgcugcggaucuuaagagcacccaaaacgccaucgacgagauuacaaauaaagucaacucugugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauuccaaugugaagaaccuguacgaaaaaguccgcagccagcucaagaacaaugccaaagagauugggaacggauguuuugaguucuaucauaagugcgacaauaccuguauggaaucugugaagaacggcacauacgauuaucccaaauacuccgaagaggcuaagcugaauagagaggaaaucgacgggguuaaacuugagagcacccggaucuaucagauucuggccaucuacuccacaguggcgucuagccucguccuggugguuucccugggcgcuauuucuuuuuggaugugcagcaacggaucccuccaaugccgcaucuguauuuga

SEQ ID NO: 192395 - RNA, 1701 nt, Artificial Sequence; identical to SEQ ID NO: 186795
  derived and/or modified sequence opt5 from hemagglutinin__InfluenzaA__AFN18917

SEQ ID NO: 192396 - RNA, 1701 nt, Artificial Sequence; identical to SEQ ID NO: 185693
  derived and/or modified sequence opt5 from hemagglutinin__InfluenzaA__AFN18927

SEQ ID NO: 192397 - RNA, 1701 nt, Artificial Sequence; identical to SEQ ID NO: 188359
  derived and/or modified sequence opt5 from hemagglutinin__InfluenzaA__AFN18937

SEQ ID NO: 192398 - RNA, 1701 nt, Artificial Sequence
  derived and/or modified sequence opt5 from hemagglutinin__InfluenzaA__AFN18952
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaauagaaaacuguguaaacuucgcgggguugcuccccugcaucucggaaagugcaacauugccggcuggauccuggggaauccugagugugaaucucugagcacagccuccucuuggagcuacauuguggagaccuccucuagcgacaacggaacgugcuauccgggcgauuuuaucgacuacgaggagcuccgggagcagcuguccagcgucucuuccuucgaaagauuugagaucuuccccaagaccagcucuuggccuaaucacgauuccaacaagggggugacagccgcuuguccccaugccggagcgaaaucuuuuuauaagaaucuuauuuggcugguuaaaaagggcaacagcuacccuaaacucuccaagagcuauaucaaugacaagggcaaagaagugcugguccuuugggggauucaccaccccuccaccucugccgaucaacagagccuguaccagaacgcugacgccuacguguucgugggaacaucccgguauagcaagaaauuuaagccugagaucgcuauucgcccgaaagucagagaucaggagggccggaugaauuacuauuggacccucguugaacccggggacaagaucacguucgaggccacaggaaaccugguggugccucgcuacgcguuugccauggaaagaaacgcuggcucugggauuaucaucuccgauacccccguccaugacugcaauacaaccugucaaaccccuaaaggagccauuaacacaagccugcccuuccagaauauccacccgauuacgaucggcaagugcccuaaguaugugaaaucuaccaagcuccggcuggcuacaggccuucgcaacguucccagcauucaguccagagggcuguuuggagccaucgccggcuucaucgaagggggauggaccggcaugguggacgggugguacggauaucaucaccagaaugaacaaggcucuggcuacgcugcggaucucaaaagcacacagaacgccauugacgagaucaccaauaaggucaacuccgugauugagaaaaugaauacgcaguuuacagcuguugggaaggaguucaaccaccuggaaaagcggaucgaaaaucuuaacaaaaagguggaugacggauuccuggauauuuggaccuacaaugccgagcuccugguccugcucgaaaacgagcgcacccuggacuaucaugauagcaaugugaaaaaccuuuacgagaaggucagaucucagcugaaaaacaaugccaaggaaaucggcaacggguguuuugaguucuaucacaagugcgacaauacauguauggaauccgugaaaaacggaaccuacgauuauccuaaguacagcgaggaagcuaaacucaaucgggagaagaucgacggcguuaaacuggagucuacacgcauuuaucaaauccuugccauuuacuccacgguggcgagcucccugguccucgugguuucucugggggcuaucagcuuuuggaugugcuccaacggcucucugcagugcagaauuuguaucuga

SEQ ID NO: 192399 - RNA, 1701 nt, Artificial Sequence
  derived and/or modified sequence opt5 from hemagglutinin__InfluenzaA__AFN18957
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaaucacaacgggaagcuguguaaacugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauugacuacgaagaacugcgggagcagcuuuccagcgucucuuccuucgaacgcuuugagaucuuccccaaaaccagcucuuggccuaaccacgauuccaauaagggagugacagccgcuuguccccaugccggcgccaagagcuuuuauaaaaaccugaucuggcucguuaagaaaggcaauucuuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuugagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 192400 - RNA, 1701 nt, Artificial Sequence; identical to SEQ ID NO: 191782
  derived and/or modified sequence opt5 from hemagglutinin__InfluenzaA__AFN18964

SEQ ID NO: 192401 - RNA, 1701 nt, Artificial Sequence
  derived and/or modified sequence opt5 from hemagglutinin__InfluenzaA__AFN18974
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcaugucuuccuucgaacgcuuugagaucuuccccaagaccagcucuuggccuaaucacgaucccaacaagggagucacagccgcuuguccucaugccggcgcgaaauccuuuuauaagaaucugaucuggcucgugaaaaagggcaacagcuaccccaaacugucuaaguccuauauuaaugacaaggggaaaaagguucuugugcuguggggaauccaccacccuagcaccuccgccgaucaacagucucucuaccagaacgcugacgccuacgucuucgugggcacaagcagauauuccaaaaaguuuaaaccggaaauugcuauccggcccaaggugcgcgaucaggaggggagaaugaauuacuauuggacccuggucgagccuggagacaaaauuacguucgaagccacaggcaaccugguugugccccgguacgcguuugccauggagcgcaacgcugggagcggaaucauuaucucugauaccccugugcaugacugcaauacaaccugucaaacccccaagggcgccaucaacacaucccucccguuccagaauauucacccuaucacgauuggcaagugccccaaauaugucaagagcaccaaacugagacuugcuacagggcugcggaacgugccuucuauccagagccgcggacucuuuggcgccauugccggguucaucgaaggaggcuggaccgggaugguugacggaugguacggcuaucaucaccagaaugagcaaggcuccggguacgcugcggaucugaagucuacacagaacgccaucgacgaaauuaccaauaaagugaacagcgucaucgagaagaugaauacgcaguuuacagcugugggaaaggaguucaaccaccuugagaaaagaauugagaaucugaacaagaaaguugaugacggcuuccucgauaucuggaccuacaaugccgaacugcuggugcuccuggagaacgaacggacccuugacuaucaugauuccaaugucaagaaccuguacgagaaagugcgcagccagcucaagaacaaugccaaggagauugggaacggauguuuugaguucuaucacaaaugcgacaauacauguauggaaucugucaagaacggcaccuacgauuaucccaaauacuccgacgaagcuaagcugaauagagaggaaaucgauggggugaaacuugagagcacacggaucuaucaaauucuggccaucuacucuacgguugcguccagccucgugcuggucgugucccugggcgcuauuucuuuuuggaugugcagcaacggaucccuccagugccgcaucuguauuuga

SEQ ID NO: 192402 - RNA, 1701 nt, Artificial Sequence; identical to SEQ ID NO: 187245
  derived and/or modified sequence opt5 from hemagglutinin__InfluenzaA__AFN18979

SEQ ID NO: 192403 - RNA, 1701 nt, Artificial Sequence
  derived and/or modified sequence opt5 from hemagglutinin__InfluenzaA__AFN18982
augaaggccauccuggugguccuccuguacaccuucgcuauugccaacgcggacacacuuugcaucggcuaucacgcuaauaacagcacggauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucgacuacgaagaacugcgggagcagcuuuccagcgucucuuccuucgaacgcuuugagaucuuccccaagacgaauagcuggccuaaccacgauucuaauaagggagugaccgccgcuuguccccaugccggcgcgaaauccuuuuauaagaaccugauuuggcucguuaaaaagggcaauagcuacccuaaacugucuaaguccuauaucaacgacaaggggaaagaagugcuuguccuguggggcauucaccaccccagcacauccgccgaucaacagucucucuaccagaaugcugacgccuacguguucgugggcaccagcagauauuccaagaaauuuaagccugagaucgcuauucggccgaaaguccgcgaucaggaggggagaaugaacuacuauuggacacugguugaacccggagacaagaucaccuucgaggccacgggcaaccugguggugccucgguacgcguuugccauggaacgcaaugcugggagcggaauuaucaucucugauacacccguccaugacugcaacaccacaugucaaaccccuaaaggcgccauuaauaccucccuccccuuccagaacauccacccgauuacaaucggcaagugcccuaaguaugugaaaagcacgaagcugagacuugcuaccgggcugcggaauguucccucuauucagagccgcggacucuuuggcgccaucgccggguucaucgagggaggcuggacagggaugguggacggaugguacggcuaucaucaccagaacgaacaaggcuccggguacgcugcggaucugaaaucuacccagcacgccauugacgagaucacaaauaaggucaacagcgugauugagaaaaugaauacccaguuuacggcuguuggaaaggaguucaaccaucuugagaagagaaucgaaaaucugaacaaaaagguggaugacggcuuccucgauauuuggacauacaaugccgagcugcugguccuccuggaaaacgagcggacccuugacuaucacgauuccaaugugaaaaaccuguacgagaagguccgcagccagcucaaaaacaaugccaaggaaaucgggaacggauguuuugaguucuaucauaagugcgacaauaccuguauggaaucugugaaaaacggcacauacgauuauccuaaguacuccgaggaagcuaaacugaauagagaggagaucaacgggguuaaacuugaaagcacccggauuuaucaaauccuggccauuuacucuacaguggcguccagccucguccuggugguuucccugggcgcuaucucuuuuuggaugugcagcaauggaucccuccagugccgcauuuguaucuga

SEQ ID NO: 192404 - RNA, 1701 nt, Artificial Sequence; identical to SEQ ID NO: 192296
  derived and/or modified sequence opt5 from hemagglutinin__InfluenzaA__AFN18984

SEQ ID NO: 192405 - RNA, 1701 nt, Artificial Sequence; identical to SEQ ID NO: 185693
  derived and/or modified sequence opt5 from hemagglutinin__InfluenzaA__AFN18986

SEQ ID NO: 192406 - RNA, 1701 nt, Artificial Sequence; identical to SEQ ID NO: 185693
  derived and/or modified sequence opt5 from hemagglutinin__InfluenzaA__AFN18988

SEQ ID NO: 192407 - RNA, 1701 nt, Artificial Sequence; identical to SEQ ID NO: 186857
  derived and/or modified sequence opt5 from hemagglutinin__InfluenzaA__AFN18993

SEQ ID NO: 192408 - RNA, 1701 nt, Artificial Sequence; identical to SEQ ID NO: 186857
  derived and/or modified sequence opt5 from hemagglutinin__InfluenzaA__AFN18999

SEQ ID NO: 192409 - RNA, 1701 nt, Artificial Sequence; identical to SEQ ID NO: 186491
  derived and/or modified sequence opt5 from hemagglutinin__InfluenzaA__AFN19006

SEQ ID NO: 192410 - RNA, 1701 nt, Artificial Sequence; identical to SEQ ID NO: 185693
  derived and/or modified sequence opt5 from hemagglutinin__InfluenzaA__AFN19026

SEQ ID NO: 192411 - RNA, 1701 nt, Artificial Sequence; identical to SEQ ID NO: 186833
  derived and/or modified sequence opt5 from hemagglutinin__InfluenzaA__AFN19036

SEQ ID NO: 192412 - RNA, 1701 nt, Artificial Sequence; identical to SEQ ID NO: 185693
  derived and/or modified sequence opt5 from hemagglutinin__InfluenzaA__AFN19043

SEQ ID NO: 192413 - RNA, 1701 nt, Artificial Sequence; identical to SEQ ID NO: 185693
  derived and/or modified sequence opt5 from hemagglutinin__InfluenzaA__AFN19053

SEQ ID NO: 192414 - RNA, 1701 nt, Artificial Sequence; identical to SEQ ID NO: 185693
  derived and/or modified sequence opt5 from hemagglutinin__InfluenzaA__AFN19063

SEQ ID NO: 192415 - RNA, 1701 nt, Artificial Sequence; identical to SEQ ID NO: 185693
  derived and/or modified sequence opt5 from hemagglutinin__InfluenzaA__AFN19070

SEQ ID NO: 192416 - RNA, 1701 nt, Artificial Sequence
  derived and/or modified sequence opt5 from hemagglutinin__InfluenzaA__AFN19076
augaaggccauccuggugguccuccuguacaccuucgcuacagccaacgcggacacgcuuugcauuggcuaucacgcuaauaacagcaccgauacaguugacaccgugcuggagaaggaugugacagucacccauuccgugaaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 192417 - RNA, 1701 nt, Artificial Sequence; identical to SEQ ID NO: 185693
  derived and/or modified sequence opt5 from hemagglutinin__InfluenzaA__AFN19082

SEQ ID NO: 192418 - RNA, 1701 nt, Artificial Sequence; identical to SEQ ID NO: 185693
  derived and/or modified sequence opt5 from hemagglutinin__InfluenzaA__AFN19088

SEQ ID NO: 192419 - RNA, 1701 nt, Artificial Sequence; identical to SEQ ID NO: 185693
  derived and/or modified sequence opt5 from hemagglutinin__InfluenzaA__AFN19097

SEQ ID NO: 192420 - RNA, 1701 nt, Artificial Sequence; identical to SEQ ID NO: 185693
  derived and/or modified sequence opt5 from hemagglutinin__InfluenzaA__AFN19104

SEQ ID NO: 192421 - RNA, 1701 nt, Artificial Sequence; identical to SEQ ID NO: 185693
  derived and/or modified sequence opt5 from hemagglutinin__InfluenzaA__AFN19113

SEQ ID NO: 192422 - RNA, 1701 nt, Artificial Sequence; identical to SEQ ID NO: 185693
  derived and/or modified sequence opt5 from hemagglutinin__InfluenzaA__AFN19119

SEQ ID NO: 192423 - RNA, 1701 nt, Artificial Sequence; identical to SEQ ID NO: 188204
  derived and/or modified sequence opt5 from hemagglutinin__InfluenzaA__AFN19125

SEQ ID NO: 192424 - RNA, 1701 nt, Artificial Sequence; identical to SEQ ID NO: 185693
  derived and/or modified sequence opt5 from hemagglutinin__InfluenzaA__AFN19134

SEQ ID NO: 192425 - RNA, 1701 nt, Artificial Sequence; identical to SEQ ID NO: 185693
  derived and/or modified sequence opt5 from hemagglutinin__InfluenzaA__AFN19144

SEQ ID NO: 192426 - RNA, 1701 nt, Artificial Sequence; identical to SEQ ID NO: 188248
  derived and/or modified sequence opt5 from hemagglutinin__InfluenzaA__AFN19154

SEQ ID NO: 192427 - RNA, 1701 nt, Artificial Sequence; identical to SEQ ID NO: 185693
  derived and/or modified sequence opt5 from hemagglutinin__InfluenzaA__AFN19164

SEQ ID NO: 192428 - RNA, 1701 nt, Artificial Sequence; identical to SEQ ID NO: 185693
  derived and/or modified sequence opt5 from hemagglutinin__InfluenzaA__AFN19174

SEQ ID NO: 192429 - RNA, 1701 nt, Artificial Sequence; identical to SEQ ID NO: 185693
  derived and/or modified sequence opt5 from hemagglutinin__InfluenzaA__AFN19184

SEQ ID NO: 192430 - RNA, 1701 nt, Artificial Sequence; identical to SEQ ID NO: 185693
  derived and/or modified sequence opt5 from hemagglutinin__InfluenzaA__AFN19194

SEQ ID NO: 192431 - RNA, 1701 nt, Artificial Sequence; identical to SEQ ID NO: 185693
  derived and/or modified sequence opt5 from hemagglutinin__InfluenzaA__AFN19203

SEQ ID NO: 192432 - RNA, 1701 nt, Artificial Sequence; identical to SEQ ID NO: 185693
  derived and/or modified sequence opt5 from hemagglutinin__InfluenzaA__AFN19213

SEQ ID NO: 192433 - RNA, 1701 nt, Artificial Sequence; identical to SEQ ID NO: 185693
  derived and/or modified sequence opt5 from hemagglutinin__InfluenzaA__AFN19223

SEQ ID NO: 192434 - RNA, 1701 nt, Artificial Sequence; identical to SEQ ID NO: 185693
  derived and/or modified sequence opt5 from hemagglutinin__InfluenzaA__AFN19233

SEQ ID NO: 192435 - RNA, 1701 nt, Artificial Sequence
  derived and/or modified sequence opt5 from hemagglutinin__InfluenzaA__AFN19243
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccaaguauagcaaaaaguuuaaaccugagauugcuaucagaccgaagguccgggaucaggaggggcgcaugaauuacuauuggacccugguugaacccggagacaaaauuacguucgaggccacaggcaaccugguggugccuagauacgcguuugccauggaacggaacgcugggucuggaaucauuaucuccgauacccccguccaagacugcaauacaaccugucagaccccuaagggcgccaucaacacaagccuccccuuccagaauauucauccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaccaucaaaaugaacagggcucuggguacgcugcggaucuuaagagcacacagaacgccaucgacgagauuaccaauaaagucaacuccgugaucgagaagaugaauacgcaguuuacagcuguuggaaaggaguucaaccaccuggagaaacgcauugaaaaucugaacaagaaaguggaugacggcuuccucgauaucuggaccuacaaugccgagcugcugguccuccuggaaaacgagagaacccuugacuaucacgauagcaaugugaagaaccuguacgagaaaguccggucucaacucaagaacaaugccaaggaaauugggaacggauguuuugaguucuaucauaaaugcgacaauacauguauggaauccgugaagaacggcaccuacgauuauccuaaauacagcgaggaagcuaagcugaaucgcgaggagaucgacgggguuaaacuugaaucuacaagaaucuaucagauucuggccaucuacuccacgguggcgagcucccucguccuggugguuucucugggcgcuauuagcuuuuggaugugcuccaacggaucucuccagugccggaucuguauuuga

SEQ ID NO: 192436 - RNA, 1701 nt, Artificial Sequence; identical to SEQ ID NO: 187809
  derived and/or modified sequence opt5 from hemagglutinin__InfluenzaA__AFN19250

SEQ ID NO: 192437 - RNA, 1701 nt, Artificial Sequence; identical to SEQ ID NO: 185693
  derived and/or modified sequence opt5 from hemagglutinin__InfluenzaA__AFN19259

SEQ ID NO: 192438 - RNA, 1701 nt, Artificial Sequence; identical to SEQ ID NO: 185693
  derived and/or modified sequence opt5 from hemagglutinin__InfluenzaA__AFN19269

SEQ ID NO: 192439 - RNA, 1701 nt, Artificial Sequence; identical to SEQ ID NO: 185693
  derived and/or modified sequence opt5 from hemagglutinin__InfluenzaA__AFN19279

SEQ ID NO: 192440 - RNA, 1701 nt, Artificial Sequence; identical to SEQ ID NO: 186554
  derived and/or modified sequence opt5 from hemagglutinin__InfluenzaA__AFN19286

SEQ ID NO: 192441 - RNA, 1701 nt, Artificial Sequence; identical to SEQ ID NO: 185693
  derived and/or modified sequence opt5 from hemagglutinin__InfluenzaA__AFN19295

SEQ ID NO: 192442 - RNA, 1701 nt, Artificial Sequence; identical to SEQ ID NO: 185693
  derived and/or modified sequence opt5 from hemagglutinin__InfluenzaA__AFN19305

SEQ ID NO: 192443 - RNA, 1701 nt, Artificial Sequence; identical to SEQ ID NO: 186559
  derived and/or modified sequence opt5 from hemagglutinin__InfluenzaA__AFN19315

SEQ ID NO: 192444 - RNA, 1701 nt, Artificial Sequence; identical to SEQ ID NO: 185693
  derived and/or modified sequence opt5 from hemagglutinin__InfluenzaA__AFN19325

SEQ ID NO: 192445 - RNA, 1701 nt, Artificial Sequence; identical to SEQ ID NO: 185693
  derived and/or modified sequence opt5 from hemagglutinin__InfluenzaA__AFN19335

SEQ ID NO: 192446 - RNA, 1701 nt, Artificial Sequence; identical to SEQ ID NO: 185693
  derived and/or modified sequence opt5 from hemagglutinin__InfluenzaA__AFN19344

SEQ ID NO: 192447 - RNA, 1701 nt, Artificial Sequence
  derived and/or modified sequence opt5 from hemagglutinin__InfluenzaA__AFN19351
augaagaccaucauugcccugagcuacauccucugccugguguucgcucagaaacuucccggcaacgacaauuccauggccacacugugucucgggcaccaugcggucccuaacggaacgauuguuaagaccaucacaaaugaucaaauugaggugaccaacgcuacagaacuggugcaaaauucuagcaucggcgagaucugcgacuccccgcaccagauucuugauggggaaaacuguacccugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacacuugaauuuaauaacgagagcuucaauuggaccggagugacgcagaacggcaccucuuccgcuugcauucgcagaagcaauaacuccuuuuucucucggcugaauuggcucacacaucugaacuuuaaguauccugcccuuaacgucaccaugcccaauaacgagcaguucgacaagcuguacaucuggggcgugcaccauccugggacagauaaagaccagauuuuucucuaugcgcaaagcucuggacgcaucaccguuuccacgaagagaagccagcaggccgugauuccgaauaucggcucccggccccgcaucagaaacauuccuucucggaucagcauuuacuggacaaucgucaaacccggggauauucugcugaucaauuccaccggaaaccucaucgcuccucgcggcuacuucaagauuagaagcgggaaaucuuccaucaugcggagcgacgcccccauuggaaaguguaauucugaaugcaucacaccgaacggcagcauuccuaaugacaagcccuuucagaacgugaaucgcaucaccuauggcgcuuguccuagauacgugaaacaauccacccugaagcuggccacagggaugcggaacguccccgagaaacagacgcgcggaaucuucggcgcgauugccggguuuaucgaaaauggaugggagggcaugguugaugggugguauggauucagacaccagaacucugagggccggggccaagcugccgaccuuaagagcacccaggcugccauugaucagaucaaugggaaacucaacagacugauuggaaagacaaacgaaaaauuccaccagaucgagaaggaauuuuccgagguggaaggccgcauucaagaccuugagaaguacguggaggauaccaaaaucgaccuguggagcuauaaugccgaacuccuggucgcucuggagaaccagcauacaaucgaucucaccgacucugaaaugaauaagcuguucgagaaaacgaagaaacagcuucgggaaaacgcggaggauauggggaauggaugcuuuaagauuuaccacaagugugacaacgccugcaucggcuccauuagaaaugggacauaugaucaugacguguaccgcgacgaggcucugaacaaucgguuccagaucaaaggcguugaacucaagagcggauacaaagauuggauucuguggaucucuuuugccaucuccugcuuccuucuguguguggcccuccugggcuuuauuaugugggcuugccaaaaggggaacgucagauguaauaucugcauuuga

SEQ ID NO: 192448 - RNA, 1701 nt, Artificial Sequence; identical to SEQ ID NO: 192098
  derived and/or modified sequence opt5 from hemagglutinin__InfluenzaA__AFN19355

SEQ ID NO: 192449 - RNA, 1701 nt, Artificial Sequence; identical to SEQ ID NO: 192098
  derived and/or modified sequence opt5 from hemagglutinin__InfluenzaA__AFN19357

SEQ ID NO: 192450 - RNA, 1701 nt, Artificial Sequence; identical to SEQ ID NO: 192098
  derived and/or modified sequence opt5 from hemagglutinin__InfluenzaA__AFN19361

SEQ ID NO: 192451 - RNA, 1701 nt, Artificial Sequence
  derived and/or modified sequence opt5 from hemagglutinin__InfluenzaA__AFN19363
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcauucgcagaagcaacucuuccuuuuucagccggcugaauuggcucacacaucugaacuuuaaguauccugcccuuaaugucaccaugcccaacaacgagcaguucgacaagcuguacaucuggggcgugcaccauccugggacggauaaagaccagauuuuucucuaugcgcaaucuuccggacgcaucacaguuagcaccaagagaucccagcaggccgugauuccgaauaucggcucucggccccgcaucagaaacauuccuagccggaucuccauuuacuggacaaucgucaaacccggggauauucugcugaucaauagcaccggaaaccucaucgcuccucgcggcuacuucaagauuagaucugggaaauccagcaucaugcggucugacgcccccauuggaaaguguaauagcgaaugcaucaccccgaacggcuccauuccuaaugacaagcccuuucagaacgugaaucgcaucacauauggcgcuuguccuagauacgugaaacaaucuacgcugaaacuugccaccgggaugcggaacguccccgagaagcagacacgcggaaucuucggcgcgauugccggguuuaucgaaaauggaugggagggcaugguugaugggugguauggauucagacaccagaacagcgagggccggggccaagcugccgaccugaaguccacccaggcugccauugaucagaucaaugggaaacucaacagacugauuggaaagacaaaugaaaaauuccaccagaucgagaaggaauuuagcgagguggaaggccgcauucaagaccuugagaaguacguggaggauaccaaaaucgaccuguggucuuauaacgccgaacuccuggucgcucuggagaaccagcauacgaucgaucucacagacuccgaaaugaauaagcuguucgagaaaaccaagaaacagcuucgggaaaacgcggaggauauggggaauggaugcuuuaagauuuaccacaagugugacaacgccugcaucggcagcauuagaaaugggaccuauaaccaugauguguaccgcgacgaggcucugaauaaccgguuccagaucaaaggcguugaacucaagucuggauacaaagacuggauucuguggaucuccuuugccaucagcugcuuccuucuguguguggcccuccugggcuuuauuaugugggcuugccaaaaggggaauaucagauguaacauuugcaucuga

SEQ ID NO: 192452 - RNA, 1701 nt, Artificial Sequence; identical to SEQ ID NO: 190006
  derived and/or modified sequence opt5 from hemagglutinin__InfluenzaA__AFN19365

SEQ ID NO: 192453 - RNA, 1701 nt, Artificial Sequence
  derived and/or modified sequence opt5 from hemagglutinin__InfluenzaA__AFN19367
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauuggcucacacaucugaacuuuaaguauccugcccuuaaugugaccaugcccaacaacgagcaguucgacaagcuguacauuuggggcguucaccauccuggcacggauaaagaccagaucuuucucuaugcgcaauccagcgggcgcauuacaguguccaccaagagaucucagcaggccgucaucccgaauauuggaagccggccccgcaucagaaacaucccuucccggauuagcaucuacuggacaauugugaaacccggcgauauccugcugauuaauucuaccgggaaccucaucgcuccucgcggauacuucaagauccaguccggcaaaagcucuauuaugagaagcgacgcccccaucgggaaguguaauuccgaaugcauuaccccgaacggaucuaucccuaaugacaagcccuuucaaaacgugaaucggauuacauauggcgcuuguccucgcuacgucaaacagagcacgcugaagcuggccaccggcaugagaaacguucccgagaaacagacacgggggaucuucggagcgaucgccggcuuuauugaaaaugggugggagggaaugguggauggcugguauggguuccgccaccaaaacuccgagggaagaggccaggcugccgaccuuaagagcacccaggcugccaucgaucagauuaauggcaaacucaaccggcugaucgggaagacaaaugaaaaauuccaccaaauugagaaggaauuuucugagguggaaggaagaauccaggaccuugagaaguacgucgaggauaccaaaauugaccugugguccuauaacgccgaacuccugguggcucuggagaaccagcauacgaucgaucucacagacagcgaaaugaauaagcuguucgagaaaaccaagaaacagcuucgcgaaaacgcggaggauaugggcaaugggugcuuuaagaucuaccacaagugugacaacgccugcauuggaucuauccggaauggcaccuauaaccaugauguuuacagagacgaggcucugaauaaccgcuuccaaauuaaagggguggaacucaaguccggcuacaaagacuggauccuguggauuagcuuugccaucuccugcuuccuucugugugucgcccuccugggauuuaucaugugggcuugccagaagggcaauauucgguguaacaucugcauuuga

SEQ ID NO: 192454 - RNA, 1701 nt, Artificial Sequence
  derived and/or modified sequence opt5 from hemagglutinin__InfluenzaA__AFN19369
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauuggcucacacaucugaacuuuaaguauccugcccuuaaugugaccaugcccaacaacgagcaguucgacaagcuguacauuuggggcguucaccauccuggcacggauaaagaccagaucuuucucuaugcgcaauccagcgggcgcauuacaguguccaccaagagaucucagcaggccgucaucccgaauauuggaagccggccccgcaucagaaacaucccuucccggauuagcaucuacuggacaauugugaaacccggcgauauccugcugauuaauucuaccgggaaccucaucgcuccucgcggauacuucaagaucagauccggcaaaagcucuauuaugcggagcgacgcccccaucgggaaguguaauuccgaaugcauuaccccgaacggaucuaucccuaaugacaagcccuuucagaacgugaaucgcauuacauauggcgcuuguccuagauacgucaaacaaagcacgcugaagcuggccaccggcaugcggaacguucccgagaaacagacacgcgggaucuucggagcgaucgccggcuuuauugaaaaugggugggagggaaugguggauggcugguauggguucagacaccagaacuccgagggacggggccaagcugccgaccuuaagagcacccaggcugccaucgaucagauuaauggcaaacucaacagacugaucgggaagacaaaugaaaaauuccaccagauugagaaggaauuuucugagguggaaggacgcauccaagaccuugagaaguacgucgaggauaccaaaauugaccugugguccuauaacgccgaacuccugguggcucuggagaaccagcauacgaucgaucucacagacagcgaaaugaauaagcuguucgagaaaaccaagaaacagcuucgggaaaacgcggaggauaugggcaaugggugcuuuaagaucuaccacaagugugacaacgccugcauuggaucuaucagaaauggcaccuauaaccaugauguuuaccgcgacgaggcucugaauaaccgguuccagauuaaagggguggaacucaaguccggcuacaaagacuggauccuguggauuagcuuugccaucuccugcuuccuucugugugucgcccuccugggauuuaucaugugggcuugccaaaagggcaauauuagauguaacaucugcauuuga

SEQ ID NO: 192455 - RNA, 1701 nt, Artificial Sequence
  derived and/or modified sequence opt5 from hemagglutinin__InfluenzaA__AFN19373
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauaacuccuuuuucucucggcugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcaaagcucuggacgcaucacgguuuccacaaagagaagccagcaggccgugauuccgaauaucggcucccggccccgcaucagaaacauuccuucucggaucagcauuuacuggaccaucgucaaacccggggauauucugcugaucaauuccacaggaaaccucaucgcuccucgcggcuacuucaagauuagaagcgggaaaucuuccaucaugcggagcgacgcccccauuggaaaguguaauucugaaugcaucaccccgaacggcagcauuccuaaugacaagcccuuucagaacgugaaucgcaucaccuauggcgcuuguccuagauacgugaaacaauccacacugaagcuggccacggggaugcggaacguccccgagaaacagacccgcggaaucuucggcgcgauugccggguuuaucgaaaauggaugggagggcaugguugaugggugguauggauucagacaccagaacucugagggccggggccaagcugccgaccuuaagagcacacaggcugccauugaucagaucaaugggaaacucaacagacugauuggaaagaccaacgaaaaauuccaccagaucgagaaggaauuuuccgagguggaaggccgcauucaagaccuugagaaguacguggaggauacaaaaaucgaccuguggagcuauaaugccgaacuccuggucgcucuggagaaccagcauaccaucgaucucacggacucugaaaugaauaagcuguucgagaaaacaaagaaacagcuucgggaaaacgcggaggauauggggaauggaugcuuuaagauuuaccacaagugugacaacgccugcaucggcuccauuagaaaugggaccuaugaucaugacguguaccgcgacgaggcucugaacaaucgguuccagaucaaaggcguugaacucaagagcggauacaaagauuggauucuguggaucucuuuugccaucuccugcuuccuucuguguguggcccuccugggcuuuauuaugugggcuugccaaaaggggaacaucagauguaauauuugcaucuga

SEQ ID NO: 192456 - RNA, 1701 nt, Artificial Sequence; identical to SEQ ID NO: 192098
  derived and/or modified sequence opt5 from hemagglutinin__InfluenzaA__AFN19375

SEQ ID NO: 192457 - RNA, 1701 nt, Artificial Sequence
  derived and/or modified sequence opt5 from hemagglutinin__InfluenzaA__AFN19377
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauuggcucacacaucugaacuuuaaguauccugcccuuaaugugaccaugcccaacaacgagcaguucgacaagcuguacauuuggggcguucaccauccuggcacggauaaagaccagaucuuucucuaugcgcaauccagcgggcgcauuacaguguccaccaagagaucucagcaggccgucaucccgaauauuggaagccggccccgcaucagaaacaucccuucccggauuagcaucuacuggacaauugugaaacccggcgauauccugcugauuaauucuaccgggaaccucaucgcuccucgcggauacuucaagaucagauccggcaaaagcucuauuaugcggagcgacgcccccaucgggaaguguaauuccgaaugcauuaccccgaacggaucuaucccuaaugacaagcccuuucagaacgugaaucgcauuacauauggcgcuuguccuagauacgucaaacaaagcacgcugaagcuggccaccggcaugcggaacguucccgagaaacagacacgcgggaucuucggagcgaucgccggcuuuauugaaaaugggugggagggaaugguggauggcugguauggguucagacaccagaacuccgagggacggggccaagcugccgaccuuaagagcacccaggcugccaucgaucagauuaauggcaaacucaacagacugaucgggaagacaaaugaaaaauuccaccagauugagaaggaauuuucugagguggaaggacgcauccaagaccuugagaaguacgucgaggauaccaaaauugaccugugguccuauaacgccgaacuccugguggcucuggagaaccagcauacgaucgaucucacagacagcgaaaugaauaagcuguucgagaaaaccaagaaacagcuucgggaaaacgcggaggauaugggcaaugggugcuuuaagaucuaccacaagugugacaacgccugcauuggaucuaucagaaauggcaccuauaaccaugauguuuaccgcgacgaggcucugaauaaccgguuccagauuaaagggguggaacucaaguccggcuacaaagacuggauccuguggauuagcuuugccaucuccugcuuccuucugugugucgcccuccugggauuuaucaugugggcuugccaaaauggcaacauuagauguaauaucugcauuuga

SEQ ID NO: 192458 - RNA, 1701 nt, Artificial Sequence; identical to SEQ ID NO: 192098
  derived and/or modified sequence opt5 from hemagglutinin__InfluenzaA__AFN19379

SEQ ID NO: 192459 - RNA, 1701 nt, Artificial Sequence; identical to SEQ ID NO: 192455
  derived and/or modified sequence opt5 from hemagglutinin__InfluenzaA__AFN19381

SEQ ID NO: 192460 - RNA, 1701 nt, Artificial Sequence; identical to SEQ ID NO: 192454
  derived and/or modified sequence opt5 from hemagglutinin__InfluenzaA__AFN19383

SEQ ID NO: 192461 - RNA, 1701 nt, Artificial Sequence
  derived and/or modified sequence opt5 from hemagglutinin__InfluenzaA__AFN19385
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauuggcucacacaucugaacuuuaaguauccugcccuuaaugugaccaugcccaacaacgagcaguucgacaagcuguacauuuggggcguucaccauccuggcacggauaaagaccagaucuuucucuaugcgcaauccagcgggcgcauuacaguguccaccaagagaucucagcaggccgucaucccgaauauuggaagccggccccgcaucagaaacaucccuucccggauuagcaucuacuggacaauugugaaacccggcgauauccugcugauuaauucuaccgggaaccucaucgcuccucgcggauacuucaagauccaguccggcaaaagcucuauuaugagaagcgacgcccccaucgggaaguguaauuccgaaugcauuaccccgaacggaucuaucccuaaugacaagcccuuucaaaacgugaaucggauuacauauggcgcuuguccucgcuacgucaaacagagcacgcugaagcuggccaccggcaugagaaacguucccgagaaacagacacgggggaucuucggagcgaucgccggcuuuauugaaaaugggugggagggaaugguggauggcugguauggguuccgccaccaaaacuccgagggaagaggccaggcugccgaccuuaagagcacccaggcugccaucgaucagauuaauggcaaacucaaccggcugaucgggaagacaaaugaaaaauuccaccaaauugagaaggaauuuucugagguggaaggaagaauccaggaccuugagaaguacgucgaggauaccaaaauugacaucugguccuauaacgccgaacugcucguggcucuggagaaccagcauacgaucgaucugacagacagcgaaaugaauaaacucuucgagaagaccaagaaacagcugcgcgaaaacgcggaggauaugggcaaugggugcuuuaagauuuaccacaagugugacaacgccugcaucggaucuauucggaauggcaccuauaaccaugauguuuacagagacgaggcucuuaauaaccgcuuccaaaucaaagggguggaacugaaguccggcuacaaagacuggauucucuggaucagcuuugccaucuccugcuuccugcuuugugucgcccugcucggauuuauuaugugggcuugccagaagggcaauauccgguguaacauuugcaucuga

SEQ ID NO: 192462 - RNA, 1701 nt, Artificial Sequence; identical to SEQ ID NO: 192454
  derived and/or modified sequence opt5 from hemagglutinin__InfluenzaA__AFN19387

SEQ ID NO: 192463 - RNA, 1701 nt, Artificial Sequence; identical to SEQ ID NO: 192098
  derived and/or modified sequence opt5 from hemagglutinin__InfluenzaA__AFN19389

SEQ ID NO: 192464 - RNA, 1701 nt, Artificial Sequence; identical to SEQ ID NO: 192098
  derived and/or modified sequence opt5 from hemagglutinin__InfluenzaA__AFN19391

SEQ ID NO: 192465 - RNA, 1701 nt, Artificial Sequence
  derived and/or modified sequence opt5 from hemagglutinin__InfluenzaA__AFN19393
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgcccuggagaaucaacacaccauugaucucacggacucugaaaugaacaaacuguucgagaagaccaaaaagcagcuuagagaaaaugcugaggauauggggaacggaugcuuuaaaaucuaccauaagugugacaaugccugcaucggcuccauucgcaacgggacauaugaucacgacguguaccgggacgaggcccugagcaauagauuccagaucaagggcguugaacucaaaucuggauacaaggauuggauucuguggaucuccuuugcuauuagcugcuuccuucuguguguggcccuccugggcuuuaucaugugggcgugccagaaagggaacauccgcuguaauauuugcaucuga

SEQ ID NO: 192466 - RNA, 1701 nt, Artificial Sequence; identical to SEQ ID NO: 192454
  derived and/or modified sequence opt5 from hemagglutinin__InfluenzaA__AFN19397

SEQ ID NO: 192467 - RNA, 1701 nt, Artificial Sequence; identical to SEQ ID NO: 192098
  derived and/or modified sequence opt5 from hemagglutinin__InfluenzaA__AFN19399

SEQ ID NO: 192468 - RNA, 1701 nt, Artificial Sequence; identical to SEQ ID NO: 192454
  derived and/or modified sequence opt5 from hemagglutinin__InfluenzaA__AFN19401

SEQ ID NO: 192469 - RNA, 1701 nt, Artificial Sequence; identical to SEQ ID NO: 192098
  derived and/or modified sequence opt5 from hemagglutinin__InfluenzaA__AFN19403

SEQ ID NO: 192470 - RNA, 1701 nt, Artificial Sequence; identical to SEQ ID NO: 192454
  derived and/or modified sequence opt5 from hemagglutinin__InfluenzaA__AFN19405

SEQ ID NO: 192471 - RNA, 1701 nt, Artificial Sequence
  derived and/or modified sequence opt5 from hemagglutinin__InfluenzaA__AFN19407
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggucuggagugacgcagaacggcaccuccagcgcuugcaugcgcagaucuaauuccagcuuuuucucucggcugaacuggcucacacaucugaauuuuaaguauccugcccuuaacgucaccaugcccaacaaugagcaguucgacaagcuguacauuuggggcgugcaccauccugggacagauaaagaccagaucuuucucuaugcgcaauccagcggacgcauuaccguuuccacgaagagaucucagcaggccgugaucccgaacauuggcagccggccccgcaucagaaauaucccuucccggauuagcaucuacuggacaauugucaaacccggggauauccugcugauuaacucuaccggaaaucucaucgcuccucgcggcuacuucaagaucagauccgggaaaagcucuauuaugcggagcgacgcccccaucggaaaguguaacuccgaaugcauuacaccgaauggcucuaucccuaacgacaagcccuuucagaaugugaaccgcauuaccuauggcgcuuguccuagauacgugaaacaaagcacccugaagcuggccacagggaugcggaauguccccgagaaacagacgcgcggaaucuucggcgcgaucgccggguuuauugaaaacggaugggagggcaugguugaugggugguauggauucagacaccaaaauuccgagggccggggccaggcugccgaccuuaagagcacccaggcugccaucgaucagauuaacgggaaacucaauagacugaucggaaagacaaacgaaaaauuccaccagauugagaaggaauuuucugagguggaaggccgcauccaagaccuugagaaguacguggaggauaccaaaauugaccugugguccuauaacgccgaacuccuggucgcucuggagaaucagcauacaaucgaucucaccgacagcgaaaugaacaagcuguucgagaaaacgaagaaacagcuucgggaaaaugcggaggauauggggaacggaugcuuuaagaucuaccacaagugugacaaugccugcauuggcucuaucagaaacgggacauaugaucaugacguguaccgcgacgaggcucugaauaaccgguuccagauuaaaggcguugaacucaaguccggauacaaagauuggauccuguggauuagcuuugccaucuccugcuuccuucuguguguggcccuccugggcuuuaucaugugggcuugccaaaaggggaauauuagauguaacaucugcauuuga

SEQ ID NO: 192472 - RNA, 1701 nt, Artificial Sequence
  derived and/or modified sequence opt5 from hemagglutinin__InfluenzaA__AFN19409
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccaucggcgagaucugcgacucuccgcaccagauucuugauggggaaaauuguacacugaucgacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauucgcagaucuaacuccagcuuuuucucucggcugaauuggcucacccaucugaacuuuaaguauccugcccuuaaugucacaaugcccaacaacgagcaguucgacaagcuguacaucuggggcgugcaccauccugggaccgauaaagaccagauuuuucucuaugcgcaauccagcggacgcaucacgguuuccacaaagagaucucagcaggccgugauuccgaauaucggcagccggccccgcaucagaaacauuccuucccggaucagcauuuacuggaccaucgucaaacccggggauauucugcugaucaauucuacaggaaaccucaucgcuccucgcggcuacuucaagauuagauccgggaaaagcucuaucaugcggagcgacgcccccauuggaaaguguaauuccgaaugcaucaccccgaacggcucuauuccuaaugacaagcccuuucagaacgugaaucgcaucaccuauggcgcuuguccuagauacgugaaacaaagcacacugaagcuggccacggggaugcggaacguccccgagaaacagacccgcggaaucuucggcgcgauugccggguuuaucgaaaauggaugggagggcaugguugaugggugguauggauucagacaccagaacuccgagggccggggccaagcugccgaccuuaagagcacacaggcugccauugaucagaucaaugggaaacucaacagacugauuggaaagaccaaugaaaaauuccaccagaucgagaaggaauuuucugagguggaaggccgcauucaagaccuugagaaguacguggaggauacaaaaaucgaccugugguccuauaacgccgaacuccuggucgcucuggagaaccagcauaccaucgaucucacggacagcgaaaugaauaagcuguucgagaaaacaaagaaacagcuucgggaaaacgcggaggauauggggaauggaugcuuuaagauuuaccacaagugugacaacgccugcaucggcucuauuagaaaugggaccuauaaccaugauguguaccgcgacgaggcucugaauaaccgguuccagaucaaaggcguugaacucaaguccggauacaaagacuggauucuguggaucagcuuugccaucuccugcuuccuucuguguguggcccuccugggcuuuauuaugugggcuugccaaaaggggaauaucagauguaacauuugcaucuga

SEQ ID NO: 192473 - RNA, 1701 nt, Artificial Sequence; identical to SEQ ID NO: 192454
  derived and/or modified sequence opt5 from hemagglutinin__InfluenzaA__AFN19411

SEQ ID NO: 192474 - RNA, 1701 nt, Artificial Sequence; identical to SEQ ID NO: 192098
  derived and/or modified sequence opt5 from hemagglutinin__InfluenzaA__AFN19413

SEQ ID NO: 192475 - RNA, 1701 nt, Artificial Sequence
  derived and/or modified sequence opt5 from hemagglutinin__InfluenzaA__AFN19415
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucugugaugcggagcgacgcccccauuggaaaguguaauuccgaaugcaucaccccgaacggcucuauuccuaaugacaagcccuuucagaacgugaaucgcaucacauauggcgcuuguccuagauacgucaaacaaagcacgcugaagcuggccaccgggaugcggaacguucccgagaaacagacacgcggaauuuucggcgcgaucgccggguuuaucgaaaauggaugggagggcaugguggaugggugguauggauucagacaccagaacuccgagggccggggccaagcugccgaccuuaagagcacccaggcugccauugaucagaucaaugggaaacucaacagacugauuggaaagacaaaugaaaaauuccaccagaucgagaaggaauuuucugagguggaaggccgcauucaagaccuugagaaguacgucgaggauaccaaaaucgaccugugguccuauaacgccgaacuccugguggcucuggagaaccagcauacgauugaucucacagacagcgaaaugaauaagcuguucgagaaaaccaagaaacagcuucgggaaaacgcggaggauauggggaauggaugcuuuaagaucuaccacaagugugacaacgccugcaucggcucuauuagaaaugggaccuauaaccaugauguuuaccgcgacgaggcucugaauaaccgguuccagaucaaaggcguggaacucaaguccggauacaaagacuggauucuguggaucagcuuugccauuuccugcuuccuucugugugucgcccuccugggcuuuaucaugugggcuugccaaaaggggaauaucagauguaacauuugcaucuga

SEQ ID NO: 192476 - RNA, 1701 nt, Artificial Sequence
  derived and/or modified sequence opt5 from hemagglutinin__InfluenzaA__AFN19417
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacagaauggcaccuccagcgcuugcauucgcagaucuaacuccagcuuuuucucucggcugaauuggcucacacaucugaacuuuaaguauccugcccuuaaugugaccaugcccaacaacgagcaguucgacaagcuguacaucuggggcguccaccauccugggacggauaaagaccagauuuuucucuaugcgcaauccagcggacgcaucacaguguccaccaagagaucucagcaggccguuauuccgaauaucggcagccggccccgcaucagaaacauuccuucccggaucagcauuuacuggacaaucgugaaacccggggauauucugcugaucaauucuaccggaaaccucaucgcuccucgcggcuacuucaagauuagauccgggaaaagcucuaucaugcggagcgacgcccccauuggaaaguguaauuccgaaugcaucaccccgaacggcucuauuccuaaugacaagcccuuucagaacgucaaucgcaucacauauggcgcuuguccuagauacgugaaacaaagcacgcugaagcuggccaccgggaugcggaacgugcccgagaaacagacacgcggaaucuucggcgcgauugccggguuuaucgaaaauggaugggagggcauggucgaugggugguauggauucagacaccagaacuccgagggccggggccaagcugccgaccuuaagagcacccaggcugccauugaucagaucaaugggaaacucaacagacugauuggaaagacaaaugaaaaauuccaccagaucgagaaggaauuuucugagguugaaggccgcauucaagaccuugagaaguacguggaggauaccaaaaucgaccugugguccuauaacgccgaacuccugguggcucuggagaaccagcauacgaucgaucucacagacagcgaaaugaauaagcuguucgagaaaaccaagaaacagcuucgggaaaacgcggaggauauggggaauggaugcuuuaagauuuaccacaagugugacaacgccugcaucggcucuauuagaaaugggaccuauaaccaugaugucuaccgcgacgaggcucugaauaaccgguuccagaucaaaggcguggaacucaaguccggauacaaagacuggauucuguggaucagcuuugccaucuccugcuuccuucuguguguugcccuccugggcuuuauuaugugggcuugccaaaaggggaauaucagauguaacauuugcaucuga

SEQ ID NO: 192477 - RNA, 1701 nt, Artificial Sequence
  derived and/or modified sequence opt5 from hemagglutinin__InfluenzaA__AFN19423
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcucugaauaacagauuccagaucaagggcguugaacucaaaagcggauacaaggauuggauucuguggaucucuuuugccaucuccugcuuccuucuguguguggcccuccugggcuuuauuaugugggcuugccagaaagggaauauccgcuguaacauuugcaucuga

SEQ ID NO: 192478 - RNA, 1701 nt, Artificial Sequence; identical to SEQ ID NO: 192454
  derived and/or modified sequence opt5 from hemagglutinin__InfluenzaA__AFN19425

SEQ ID NO: 192479 - RNA, 1701 nt, Artificial Sequence
  derived and/or modified sequence opt5 from hemagglutinin__InfluenzaA__AFN19437
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcaaucuuccggacgcaucacgguuagcacaaagagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucagaauuagaucugggaaguccagcaucaugcgcucugacgcccccauuggaaaauguaacagcgaaugcaucaccccgaauggcuccauuccuaacgacaagcccuuucagaaugugaacagaaucaccuauggcgcuuguccucgguacgugaagcaaucuacacugaaacuugccacggggaugcgcaauguccccgagaagcagaccagaggaaucuucggcgcgauugccggguuuaucgaaaacggaugggagggcaugguugaugggugguauggauuccggcaccagaauagcgagggcagaggccaagcugccgaccugaaauccacacaggcugccauugaucagaucaaccgcaagcucaaucggcugauugggaaaaccaacgaaaaguuccaccagaucgagaaagaauuuagcgagguggaaggacggauucaagaccuugagaaguacguggaggauacaaagaucgaccuguggucuuauaacgccgaacuccuggucgcucuggagaaucagcauaccaucgaucucacggacuccgaaaugaacaaacuguucgagaagaccaaaaagcagcuucgcgaaaaugcggaggauaugggcaacgggugcuuuaaaauuuaccacaagugugacaaugccugcaucggaagcauucggaacggcacauaugaucauuacguguacagagacgaggcucugaauaaccgcuuccagaucaaggggguugaacucaaaucuggcuauaaggacuggauucuguggaucuccuuugccaucagcugcuuccuucuguguguggcccuccugggauuuauuaugugggcuugccaaaaaggcaauauccgguguaacauuugcaucuga

SEQ ID NO: 192480 - RNA, 1701 nt, Artificial Sequence
  derived and/or modified sequence opt5 from hemagglutinin__InfluenzaA__AFN19439
augaagaccaucauugcccugagccacauccucugccugguguucgcucagaaacuucccgagaacgacaauuccacagccacgcugugucucggccaucacgcggucccuaacgggaccauuguuaagacaaucaccaaugaucaaauugaagugacaaacgcuaccgagcuggugcagucuagcuccacaggagaaaucugcgacucuccgcaucagauccuugauggcauuaauuguacccugaucgacgcccuccugggggauccccagugcgacggauuucaaaacaaaaagugggaucuguucgucgagagaagcaaagccuacuccaauuguuauccuuacgacgugcccgauuaugcuucucuccggagccugguugccuccagcggcacgcuugaauuuaacaaugagucuuucaacuggaccggggugacacagaauggaaccuccagcgcuugcauucgcagaucuaacuccagcuuuuucucucggcugaauuggcucacacaccugaacuuuaaguacccugcccuuaaugucaccaugcccaacaacgagcaguucgacaagcuguauaucuggggcgugcaucacccuggcacggauaaagaccagauuuuucucuacgcgcaaccguccgggcgcaucacaguuagcaccaagagaucccagcaggccgugauucccaauaucggaucucggccucgcaucagaaacauucccagccggaucuccauuuauuggacaaucgucaaaccuggcgauauucugcugaucaauagcaccgggaaccucaucgcuccccgcggauacuucaagauuagaucuggcaaauccagcaucaugcggucugacgccccgauugggaaguguaauagcgaaugcaucaccccuaacggauccauucccaaugacaagccuuuucagaacgugaaucgcaucacauacggcgcuugucccagauaugugaaacaaucuacgcugaaacuugccaccggcaugcggaacguccccgagaagcagacacgcgggaucuucggagcgauugccggcuuuaucgaaaaugggugggagggaaugguugauggcugguacggguucagacaccagaacagcgagggacggggccaagcugccgaccugaaguccacccaggcugccauugaucagaucaauggcaaacucaacagacugauugggaagacaaaugaaaaauuccaucagaucgagaaggaauuuagcgagguggaaggacgcauucaagaccuugagaaguauguggaggauaccaaaaucgaccuguggucuuacaacgccgaacuccuggucgcucuggagaaccagcacacgaucgaucucacagacuccgaaaugaauaagcuguucgagaaaaccaagaaacagcuucgggaaaacgcggaggauaugggcaaugggugcuuuaagauuuaucauaagugugacaacgccugcaucggaagcauuagaaauggcaccuacaaccacgauguguaucgcgacgaggcucugaauaaccgguuccagaucaaagggguugaacucaagucuggcuacaaagacuggauucuguggaucuccuuugccaucagcugcuuccuucuguguguggcccuccugggauuuauuaugugggcuugccaaaagggcaauaucagauguaacauuugcaucuga

SEQ ID NO: 192481 - RNA, 1701 nt, Artificial Sequence; identical to SEQ ID NO: 192455
  derived and/or modified sequence opt5 from hemagglutinin__InfluenzaA__AFN19443

SEQ ID NO: 192482 - RNA, 1701 nt, Artificial Sequence
  derived and/or modified sequence opt5 from hemagglutinin__InfluenzaA__AFN19445
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacagcuuuuucucccgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugcgccuugccacggggaugagaaauguccccgagaaacaaacccggggaaucuucggcgcgauugccggguuuaucgaaaacggaugggagggcaugguugaugggugguauggauucagacaccaaaauucugagggccgcggccaggcugccgaccugaagucuacacaggcugccauugaucagaucaacgggaaacucaaucggcugauuggaaagaccaacgaaaaauuccaccagaucgagaaggaauuuuccgagguggaaggccgcauucaggaccuugagaaguacguggaggauacaaaaaucgaccuguggagcuauaacgccgaacuccuggucgcucuggagaaucaacauaccaucgaucucacggacucugaaaugaacaagcuguucgagaaaacaaagaaacagcuuagagaaaaugcggaggauauggggaacggaugcuuuaagauuuaccacaagugugacaaugccugcaucggcuccauucggaacgggaccuaugaucaugacguguacagagacgaggcucugaauaaccgcuuccagaucaaaggcguugaacucaagagcggauacaaagauuggauucuguggaucucuuuugccaucuccugcuuccuucuguguguggcccuccugggcuuuauuaugugggcuugccagaaggggaauauccgguguaacauuugcaucuga

SEQ ID NO: 192483 - RNA, 1701 nt, Artificial Sequence; identical to SEQ ID NO: 192477
  derived and/or modified sequence opt5 from hemagglutinin__InfluenzaA__AFN19447

SEQ ID NO: 192484 - RNA, 1701 nt, Artificial Sequence
  derived and/or modified sequence opt5 from hemagglutinin__InfluenzaA__AFN19451
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcaaucuuccggacgcaucacgguuagcacaaagagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucaagauuagaucugggaaauccagcaucaugcggucugacgcccccauuggaaaguguaacagcgaaugcaucaccccgaauggcuccauuccuaacgacaagcccuuucagaaugugaaccgcaucaccuauggcgcuuguccuagauacgugaaacaaucuacacugaaacuugccacggggaugcggaauguccccgagaagcagacccgcggaaucuucggcgcgauugccggguuuaucgaaaacggaugggagggcaugguugaugggugguauggauucagacaccagaauagcgagggccggggccaagcugccgaccugaaguccacacaggcugccauugaucagaucaacgggaaacucaauagacugauuggaaagaccaacgaaaaauuccaccagaucgagaaggaauuuagcgagguggaaggccgcauucaagaccuugagaaguacguggaggauacaaaaaucgaccuguggucuuauaacgccgaacuccuggucgcucuggagaaucagcauaccaucgaucucacggacuccgaaaugaacaagcuguucgagaaaacaaagaaacagcuucgggaaaaugcggaggauauggggaacggaugcuuuaagauuuaccacaagugugacaaugccugcaucggcagcauuagaaacgggaccuaugaucaugacguguaccgcgacgaggcucugaauaaccgguuccagaucaauggcguugaacucaaaucuggauacaaggauuggauucuguggaucuccuuugccaucagcugcuuccuucuguguguggcccuccugggcuuuauuaugugggcuugccaaaaagggaacaucagauguaauauuugcaucuga

SEQ ID NO: 192485 - RNA, 1701 nt, Artificial Sequence
  derived and/or modified sequence opt5 from hemagglutinin__InfluenzaA__AFN19453
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcaaucuuccggacgcaucacgguuagcacaaagagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucaagauuagaucugggaaauccagcaucaugcggucugacgcccccauuggaaaguguaacagcgaaugcaucaccccgaauggcuccauuccuaacgacaagcccuuucagaaugugaaccgcaucaccuauggcgcuuguccuagauacgugaaacaaucuacacugaaacuugccacggggaugcggaauguccccgagaagcagacccgcggaaucuucggcgcgauugccggguuuaucgaaaacggaugggagggcaugguugaugggugguauggauucagacaccagaauagcgagggccggggccaagcugccgaccugaaguccacacaggcugccauugaucagaucaacgggaaacucaauagacugauuggaaagaccaacgaaaaauuccaccagaucgagaaggaauuuagcgagguggaaggccgcauucaagaccuugagaaguacguggaggauacaaaaaucgaccuguggucuuauaacgccgaacuccuggucgcucuggagaaucagcauaccaucgaucucacggacuccgaaaugaacaagcuguucgagaaaacaaagaaacagcuucgggaaaaugcggaggauauggggaacggaugcuuuaagauuuaccacaagugugacaaugccugcaucggcagcauuagaaacgggaccuaugaucaugacguguaccgcgacgaggcucugaauaaccgguuccagguuaaaggcguggaacucaagucuggauacaaagauuggauccuguggauuuccuuugccaucagcugcuuccuucugugugucgcccuccugggcuuuaucaugugggcuugccaaaaggggaauauuagauguaacaucugcauuuga

SEQ ID NO: 192486 - RNA, 1701 nt, Artificial Sequence; identical to SEQ ID NO: 192477
  derived and/or modified sequence opt5 from hemagglutinin__InfluenzaA__AFN19455

SEQ ID NO: 192487 - RNA, 1701 nt, Artificial Sequence; identical to SEQ ID NO: 192098
  derived and/or modified sequence opt5 from hemagglutinin__InfluenzaA__AFN19457

SEQ ID NO: 192488 - RNA, 1701 nt, Artificial Sequence; identical to SEQ ID NO: 192098
  derived and/or modified sequence opt5 from hemagglutinin__InfluenzaA__AFN19459

SEQ ID NO: 192489 - RNA, 1701 nt, Artificial Sequence; identical to SEQ ID NO: 192455
  derived and/or modified sequence opt5 from hemagglutinin__InfluenzaA__AFN19461

SEQ ID NO: 192490 - RNA, 1701 nt, Artificial Sequence
  derived and/or modified sequence opt5 from hemagglutinin__InfluenzaA__AFN19465
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagacagcgaaaugaauaagcuguucgagaaaaccaagaaacagcuucgggaaaacgcggaggauaucgggaauggaugcuuuaagauuuaccacaagugugacaacgccugcaucggcucuauuagaaaugggaccuauaaccaugauguguaccgcgacgaggcucugaauaaccgguuccagaucaaaggcguugaacucaaguccggauacaaagacuggauucuguggaucagcuuugccaucuccugcuuccuucuguguauugcccuccugggcuuuaucaugugggcuugccaaaaggggaauauuagauguaacaucugcauuuga

SEQ ID NO: 192491 - RNA, 1701 nt, Artificial Sequence; identical to SEQ ID NO: 192477
  derived and/or modified sequence opt5 from hemagglutinin__InfluenzaA__AFN19467

SEQ ID NO: 192492 - RNA, 1701 nt, Artificial Sequence; identical to SEQ ID NO: 192485
  derived and/or modified sequence opt5 from hemagglutinin__InfluenzaA__AFN19469

SEQ ID NO: 192493 - RNA, 1701 nt, Artificial Sequence; identical to SEQ ID NO: 192098
  derived and/or modified sequence opt5 from hemagglutinin__InfluenzaA__AFN19471

SEQ ID NO: 192494 - RNA, 1701 nt, Artificial Sequence
  derived and/or modified sequence opt5 from hemagglutinin__InfluenzaA__AFN19473
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgggucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucaacuggaccggcgugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgauaagcuguacauuuggggagugcaccauccugggacggacaaagaucagaucuuucucuaugcgcaauccagcggccgcauuacaguuuccaccaagagaucucagcaggccgugaucccgaauauugggagccggccccgcaucagaaacaucccuucccggauuagcaucuacuggacaauugucaaacccggagacauccugcugauuaauucuaccggcaaccucaucgcuccucgcggguacuucaagaucagauccggaaaaagcucuauuaugcggagcgaugcccccaucggcaaguguaauuccgaaugcauuaccccgaacggcucuaucccuaaugacaagcccuuucagaacgugaaucgcauuacauauggggcuuguccuagauacgugaaacaaagcacgcugaagcuggccaccggaaugcggaacguccccgagaaacagacacgcggcaucuucggggcgaucgccggauuuauugaaaauggcugggaggggaugguugacggaugguauggcuucagacaccagaacuccgagggccgggggcaagcugccgaucuuaagagcacccaggcugccaucgaccagauuaauggaaaacucaacagacugaucggcaagacaaaugaaaaauuccaccagauugagaaggaauuuucugagguggaagggcgcauccaagaucuugagaaguacguggaggacaccaaaauugaucugugguccuauaacgccgaacuccuggucgcucuggagaaccagcauacgaucgaccucacagauagcgaaaugaauaagcuguucgagaaaaccaagaaacagcuucgggaaaacgcggaggacaugggaaauggcugcuuuaagaucuaccacaagugugauaacgccugcauugggucuaucagaaauggcaccuauaaccaugacguguaccgcgaugaggcucugaauaaccgguuccagauuaaaggaguugaacucaaguccggcuacaaagacuggauccuguggauuagcuuugccaucuccugcuuccuucuguguguggcccuccugggguuuaucaugugggcuugccaaaagggaaauauuagauguaacaucugcauuuga

SEQ ID NO: 192495 - RNA, 1701 nt, Artificial Sequence; identical to SEQ ID NO: 192477
  derived and/or modified sequence opt5 from hemagglutinin__InfluenzaA__AFN19475

SEQ ID NO: 192496 - RNA, 1701 nt, Artificial Sequence; identical to SEQ ID NO: 192098
  derived and/or modified sequence opt5 from hemagglutinin__InfluenzaA__AFN19477

SEQ ID NO: 192497 - RNA, 1701 nt, Artificial Sequence
  derived and/or modified sequence opt5 from hemagglutinin__InfluenzaA__AFN19479
augaagaccaucauugcccugagcugcauccucugucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcaaaauucuagcaucggcgagaucugugacuccccgcaccagauucuugauggggaaaacugcacacugaucgacgcccuccugggagauccccagugugacggcuuucagaauaaaaagugggaucuguucgucgagagaucuaaagccuacagcaacugcuauccuuacgacgugcccgauuaugcuucccuccggucucugguugccagcuccgggacccuugaauuuaauaacgagagcuucaauuggacgggagugacccagaacggcacaucuuccgcuuguauucgcagaagcaauucuuccuuuuucagccggcugaacuggcucacccaucugaauuuuaaguacccugcccuuaacgucacaaugcccaacaaugagcaguucgacaagcuguauaucuggggcgugcaccauccugggaccgauaaagaccagauuuuucucuacgcgcaaucuuccggacgcaucacgguuagcacaaagagaucccagcaggccgugauuccgaacaucggcucucggccccgcaucagaaauauuccuagccggaucuccauuuauuggaccaucgucaaacccggggauauucugcugaucaacagcacaggaaaucucaucgcuccucgcggcuacuucaagauuagaucugggaaauccagcaucaugcggucugacgcccccauuggaaagugcaacagcgaauguaucaccccgaauggcuccauuccuaacgacaagcccuuucagaaugugaaccgcaucaccuacggcgcuugcccuagauaugugaaacaaucuacacugaaacuugccacggggaugcggaauguccccgagaagcagacccgcggaaucuucggcgcgauugccggguuuaucgaaaacggaugggagggcaugguugaugggugguacggauucagacaccagaauagcgagggccggggccaagcugccgaccugaaguccacacaggcugccauugaucagaucaacgggaaacucaauagacugauuggaaagaccaacgaaaaauuccaccagaucgagaaggaauuuagcgagguggaaggccgcauucaagaccuugagaaguauguggaggauacaaaaaucgaccuguggucuuacaacgccgaacuccuggucgcucuggagaaucagcauaccaucgaucucacggacuccgaaaugaacaagcuguucgagaaaacaaagaaacagcuucgggaaaaugcggaggauauggggaacggauguuuuaagauuuaucacaagugcgacaaugccugcaucggcagcauuagaaacgggaccuacgaucaugacguguaucgcgacgaggcucugaauaaccgguuccagaucaaaggcguugaacucaagucuggauacaaagauuggauucuguggaucuccuuugccaucagcuguuuccuucugugcguggcccuccugggcuuuauuaugugggcuugucaaaaggggaauaucagaugcaacauuuguaucuga

SEQ ID NO: 192498 - RNA, 1701 nt, Artificial Sequence; identical to SEQ ID NO: 192477
  derived and/or modified sequence opt5 from hemagglutinin__InfluenzaA__AFN19483

SEQ ID NO: 192499 - RNA, 1701 nt, Artificial Sequence; identical to SEQ ID NO: 189879
  derived and/or modified sequence opt5 from hemagglutinin__InfluenzaA__AFN19485

SEQ ID NO: 192500 - RNA, 1701 nt, Artificial Sequence; identical to SEQ ID NO: 192098
  derived and/or modified sequence opt5 from hemagglutinin__InfluenzaA__AFN19487

SEQ ID NO: 192501 - RNA, 1701 nt, Artificial Sequence
  derived and/or modified sequence opt5 from hemagglutinin__InfluenzaA__AFN19491
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagacagcgaaaugaauaagcuguucgagaaaaccaagaaacagcuucgggaaaacgcggaggauauggggaauggaugcuuuaagaucuaccacaagugugacaacgccugcauuggcucuaucagaaaugggaccuauaaccaugauguguaccgcgacgaggcucugaauaaccgguuccagauuaaaggcguugaacucaaguccggauacaaagacuggauccuguggauuagcuuugccaucuccugcuuccuucugugugugguccuccugggcuuuaucaugugggccugccaaaaggggaauauuagauguaacaucugcauuuga

SEQ ID NO: 192502 - RNA, 1701 nt, Artificial Sequence
  derived and/or modified sequence opt5 from hemagglutinin__InfluenzaA__AFN19493
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcagacagugaucccgaauauuggcucccggccccgcgucagaaacaucccuucucgggugagcaucuauuggaccauugugaaacccggggacauccugcugauuaauuccaccggaaaccucaucgcuccucgcggcuacuucaagauuagaagcgggaaaucuuccaucaugcggagcgaugcccccaucggaaaguguaauucugcuugcauuacaccgaacggcagcaucccuaaugacaagcccuuucagaacgucaaucgcauuacguacggcgccuguccuagauauguuaaacaaaacacccugaaacuugcgacagggaugcggaaugugcccgaaaaacagacccgcggaaucuucggcgccauugcuggguuuaucgagaacggaugggaaggcaugguggacgggugguacggauucagacaccaaaauuccgagggccggggccaggccgcugaucugaagucuacacaggccgccaucgaccagauuaacgggaaacucaacagacugaucggaaagaccaaugagaaauuccaucagauugaaaaggaguuuagcgaagucgagggccgcauccaagaucuugaaaaguauguggaggacacgaaaauugaucugugguccuacaacgcugagcuccugguugcgcuggaaaaucagcacacaaucgaccucaccgauagcgagaugaacaagcuguucgaaaagaccaagaaacagcuucgggagaaugccgaagacauggggaacggaugcuuuaagauuuaucauaagugugauaaugcuugcaucggcucuaucagaaacgggacauacgaccacgauguguaucgcgacgaggcccugaauaaccgguuccagauuaaaggcgucgagcucaaguccggauacaaagacuggauccuguggauuagcuuugccaucucuugcuuccuucuguguguggcucuccugggcuuuauuaugugggccugccaaaaggggaauaucagauguaacaucugcauuuga

SEQ ID NO: 192503 - RNA, 1701 nt, Artificial Sequence
  derived and/or modified sequence opt5 from hemagglutinin__InfluenzaA__AFN19495
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccgccggcgagaucugcgacucuccgcaccauauucuggauggggaaaauuguacacuuaucgacgcccugcucggagauccccagugcgacggcuuucagaacaaaaagugggaucuguucgucgagagaagccgggcuuauuccaauuguuacccuuaugacgugcccgauuacgccucucugcgcagccucguugcuuccagcgggacccuggaauuuaacaaugagucuuucaacuggacgggagugacccaaaauggcacauccagcgccugcauuagacggucuaacaauuccuuuuucagccgccuuaacuggcugacccaccucaauuuuaaauauccugcgcugaacgucacaaugcccaacaaugagcaguucgacaaacuuuacaucuggggcgugcaucacccugggaccgauaaggaccagauuuuucuguaugcccaggcuucuggaagaaucacgguuuccacaaaacggagccaacaggccgugauuccgaacaucggcucccgccccagaguccggaauaucccuucucgcauuagcaucuacuggaccauugugaagcccggggauauccuccugauuaacuccacaggaaaucugaucgcuccuagaggcuacuucaaaauccggagcgggaagucuuccauuaugcgcagcgacgcccccaucggaaaauguaacucugaaugcauuaccccgaauggcagcaucccuaacgacaagcccuuucagaaugugaacagaauuaccuauggcgcguguccucgguacgucaagcaguccacacucaaacuggccacggggaugcgcaauguucccgagaagcaaaccagaggaaucuucggcgcuaucgccggguuuauugaaaacggaugggagggcaugauggaugggugguauggauuccggcaccaaaauucugagggcagaggccaggcugccgaccuuaaaagcacacaggccgcuaucgaucagauuaacgggaagcugaaucgccucaucggaaaaaccaacgaaaaguuccaucagauugagaaagaauuuuccgagguggaaggccggauccaggaccuggagaaguacguggaggauacaaagauugaccuuuggagcuauaacgcggaacugcucgucgcccuggagaaucaacacaccaucgaucugacggacucugaaaugaacaaacucuucgagaagacaaagaagcagcugagagaaaaugcugaggauauggggaacggaugcuuuaaaaucuaccauaagugugacaaugccugcauuggcuccauccgcaacgggaccuaugaucacgacguguaccgggacgaggcccuuaauaacagauuccagauuaagggcguugaacugaaaagcggauacaaggauuggauccucuggauuucuuuugcuaccuccugcuuccugcuuuguguggcccugcucggcuuuaucaugugggcgugccagaaagggaauauccgcuguaacauuugcaucuga

SEQ ID NO: 192504 - RNA, 1701 nt, Artificial Sequence
  derived and/or modified sequence opt5 from hemagglutinin__InfluenzaA__AFN19497
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcaauucuccgcaccagauccuugacggcgagaacuguacccugauugaugcccuccugggggacccccagugcgauggauuucaaaauaaaaagugggaccuguucgucgaaagaagcaaagcccauuccaacuguuauccuuacgaugugcccgacuaugcuucucuccggagccugguugccuccagcggcacgcuugaguuuaauaacgagucuuucaauuggaccggggugacacagaacggaaccuccagcgcuugcauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccuggcacggacaaagaucagaucuuucucuacgcgcaagccucugggcgcauuacaguuuccaccaagagaagccagcaggcugugaucccgaauauuggaucccggccccgcgucagaaacaucccuucucgggugagcaucuauuggacaauugugaaacccggcgacauccugcugauuaauuccaccgggaaccucaucgccccucgcggauacuucaagauuagaagcggcaaaucuuccaucaugcggagcgaugcucccaucgggaaguguaauucuaccugcauuacaccgaacggaagcaucccuaaugacaagcccuuucagaacgucaaucgcauuacguacggcgccuguccuagauauguuaaacaaaacacccugaaacuugcgacaggcaugcggaaugugcccgagaagcagacccgcgggaucuucggagccauugcuggcuuuaucgaaaacgggugggagggaaugguggacggcugguacggguucagacaccaaaauuccgagggacggggccaggccgcugaucugaagucuacacaggccgccaucgaccagauuaacggcaaacucaacagacugaucgggaagaccaaugaaaaauuccaucagauugagaaggaauuuagcgaggucgaaggacgcauccaagaucuugagaaguauguggaggacacgaaaauugaucugugguccuacaacgcugaacuccugguugcgcuggagaaucagcacacaaucgaccucaccgauagcgaaaugaacaagcuguucgagaaaaccaagaaacagcuucgggaaaaugccgaggacaugggcaacgggugcuuuaagauuuaucauaagugugauaaugcuugcaucggaucuaucagaaacggcacauacgaccacgauguguaucgcgacgaggcccugaauaaccgguuccagauuaaaggggucgaacucaaguccggcuacaaagacuggauccuguggauuagcuuugccaucucuugcuuccuucuguguguggcucuccugggauuuauuaugugggccugccaaaagggcaauaucagauguaacaucugcauuuga

SEQ ID NO: 192505 - RNA, 1701 nt, Artificial Sequence; identical to SEQ ID NO: 192455
  derived and/or modified sequence opt5 from hemagglutinin__InfluenzaA__AFN19499

SEQ ID NO: 192506 - RNA, 1701 nt, Artificial Sequence; identical to SEQ ID NO: 192454
  derived and/or modified sequence opt5 from hemagglutinin__InfluenzaA__AFN19501

SEQ ID NO: 192507 - RNA, 1701 nt, Artificial Sequence; identical to SEQ ID NO: 190006
  derived and/or modified sequence opt5 from hemagglutinin__InfluenzaA__AFN19503

SEQ ID NO: 192508 - RNA, 1701 nt, Artificial Sequence; identical to SEQ ID NO: 192455
  derived and/or modified sequence opt5 from hemagglutinin__InfluenzaA__AFN19507

SEQ ID NO: 192509 - RNA, 1701 nt, Artificial Sequence; identical to SEQ ID NO: 192454
  derived and/or modified sequence opt5 from hemagglutinin__InfluenzaA__AFN19509

SEQ ID NO: 192510 - RNA, 1701 nt, Artificial Sequence; identical to SEQ ID NO: 192455
  derived and/or modified sequence opt5 from hemagglutinin__InfluenzaA__AFN19513

SEQ ID NO: 192511 - RNA, 1701 nt, Artificial Sequence; identical to SEQ ID NO: 192454
  derived and/or modified sequence opt5 from hemagglutinin__InfluenzaA__AFN19515

SEQ ID NO: 192512 - RNA, 1701 nt, Artificial Sequence; identical to SEQ ID NO: 192455
  derived and/or modified sequence opt5 from hemagglutinin__InfluenzaA__AFN19517

SEQ ID NO: 192513 - RNA, 1701 nt, Artificial Sequence; identical to SEQ ID NO: 192455
  derived and/or modified sequence opt5 from hemagglutinin__InfluenzaA__AFN19519

SEQ ID NO: 192514 - RNA, 1701 nt, Artificial Sequence; identical to SEQ ID NO: 192098
  derived and/or modified sequence opt5 from hemagglutinin__InfluenzaA__AFN19521

SEQ ID NO: 192515 - RNA, 1701 nt, Artificial Sequence; identical to SEQ ID NO: 192454
  derived and/or modified sequence opt5 from hemagglutinin__InfluenzaA__AFN19523

SEQ ID NO: 192516 - RNA, 1701 nt, Artificial Sequence
  derived and/or modified sequence opt5 from hemagglutinin__InfluenzaA__AFN19527
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcaaaauucuagcauuggcgagaucugcgacuccccgcaccagauccuugauggggaaaacuguacccugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauucuuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaaucuuccggacgcauuacaguuagcaccaagagaucccagcaggccgugaucccgaacauuggcucucggccccgcaucagaaauaucccuagccggauuuccaucuacuggacaauugucaaacccggggauauccugcugauuaacagcaccggaaaucucaucgcuccucgcggcuacuucaagaucagaucugggaaauccagcauuaugcggucugacgcccccaucggaaaguguaacagcgaaugcauuaccccgaauggcuccaucccuaacgacaagcccuuucagaaugugaaccgcauuacauauggcgcuuguccuagauacgugaaacaaucuacgcugaaacuugccaccgggaugcggaauguccccgagaagcagacacgcggaaucuucggcgcgaucgccggguuuauugaaaacggaugggagggcaugguugaugggugguauggauucagacaccagaauagcgagggccggggccaagcugccgaccugaaguccacccaggcugccaucgaucagauuaacgggaaacucaauagacugaucggaaagacaaacgaaaaauuccaccagauugagaaggaauuuagcgagguggaaggccgcauccaagaccuugagaaguacguggaggauaccaaaauugaccuguggucuuauaacgccgaacuccuggucgcucuggagaaucagcauacgaucgaucucacagacuccgaaaugaacaagcuguucgagaaaaccaagaaacagcuucgggaaaaugcggaggauauggggaacggaugcuuuaagaucuaccacaagugugacaaugccugcauuggcagcaucagaaacgggaccuaugaucaugacguguaccgcgacgaggcucugaauaaccgguuccagauuaaaggcguugaacucaagucuggauacaaagauuggauccuguggauuuccuuugccaucagcugcuuccuucuguguguggcccuccugggcuuuaucaugugggcuugccaaaaggggaauauuagauguaacaucugcauuuga

SEQ ID NO: 192517 - RNA, 1701 nt, Artificial Sequence
  derived and/or modified sequence opt5 from hemagglutinin__InfluenzaA__AFN19529
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauucuuccuuuuucagccggcugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcaaucuuccggacgcaucacgguuagcacaaagagaucccagcaggccgugauuccgaacaucggcucucggccccgcaucagaaauauuccuagccggaucuccauuuacuggaccaucgucaaacccggggauauucugcugaucaacagcacaggaaaucucaucgcuccucgcggcuacuucaagauuagaucugggaaauccagcaucaugcggucugacgcccccauuggaaaguguaacagcgaaugcaucaccccgaauggcuccauuccuaacgacaagcccuuucagaaugugaaccgcaucaccuauggcgcuuguccuagauacgugaaacaaucuacacugaaacuugccacggggaugcggaauguccccgagaagcagacccgcggaaucuucggcgcgauugccggguuuaucgaaaacggaugggagggcaugguugaugggugguauggauucagacaccagaauagcgagggccggggccaagcugccgaccugaaguccacacaggcugccauugaucagaucaacgggaaacucaauagacugauuggaaagaccaacgaaaaauuccaccagaucgagaaggaauuuagcgagguggaaggccgcauucaagaccuugagaaguacguggaggauacaaaaaucgaccuguggucuuauaacgccgaacuccuggucgcucuggagaaucagcauaccaucgaucucacggacuccgaaaugaacaagcuguucgagaaaacaaagaaacagcuucgggaaaaugcggaggauauggggaacggaugcuuuaagauuuaccacaagugugacaaugccugcaucggcagcauuagaaacgggaccuaugaucaugacguguaccgcgacgaggcucugaauaaccgguuccagaucaaaggcguugaacucaagucuggauacaaagauuggauucuguggaucuccuuugccaucagcugcuuccuucuguguguggcccuccugggcuuuauuaugugggcuugccaaaaggggaauaucagauguaacauuugcaucuga

SEQ ID NO: 192518 - RNA, 1701 nt, Artificial Sequence; identical to SEQ ID NO: 192098
  derived and/or modified sequence opt5 from hemagglutinin__InfluenzaA__AFN19531

SEQ ID NO: 192519 - RNA, 1701 nt, Artificial Sequence; identical to SEQ ID NO: 192517
  derived and/or modified sequence opt5 from hemagglutinin__InfluenzaA__AFN19533

SEQ ID NO: 192520 - RNA, 1701 nt, Artificial Sequence
  derived and/or modified sequence opt5 from hemagglutinin__InfluenzaA__AFN19535
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauucgcagaucuaacuccagcuuuuucucucggcuuaauuggcugacacaucucaacuuuaaguauccugcccugaaugucaccaugcccaacaacgagcaguucgacaaacuuuacaucuggggcgugcaccauccugggacggauaaggaccagauuuuucuguaugcgcaauccagcggacgcaucacaguuuccaccaagagaucucagcaggccgugauuccgaauaucggcagccggccccgcaucagaaacauuccuucccggaucagcauuuacuggacaaucgucaaacccggggauauucuccugaucaauucuaccggaaaccugaucgcuccucgcggcuacuucaagauuagauccgggaaaagcucuaucaugcggagcgacgcccccauuggaaaguguaauuccgaaugcaucaccccgaacggcucuauuccuaaugacaagcccuuucagaacgugaaucgcaucacauauggcgcuuguccuagauacgugaaacaaagcacgcucaagcuggccaccgggaugcggaacguccccgagaaacagacacgcggaaucuucggcgcgauugccggguuuaucgaaaauggaugggagggcaugguugaugggugguauggauucagacaccagaacuccgagggccggggccaagcugccgaccuuaagagcacccaggcugccauugaucagaucaaugggaaacugaacagacucauuggaaagacaaaugaaaaauuccaccagaucgagaaggaauuuucugagguggaaggccgcauucaagaccuggagaaguacguggaggauaccaaaaucgaccuuugguccuauaacgccgaacugcucgucgcucuggagaaccagcauacgaucgaucugacagacagcgaaaugaauaaacucuucgagaagaccaagaaacagcugcgggaaaacgcggaggauauggggaauggaugcuuuaagauuuaccacaagugugacaacgccugcaucggcucuauuagaaaugggaccuauaaccaugauguguaccgcgacgaggcucuuaauaaccgguuccagaucaaaggcguugaacugaaguccggauacaaagacuggauucucuggaucagcuuugccaucuccugcuuccugcuuuguguggcccugcucggcuuuauuaugugggcuugccaaaaggggaauaucagauguaacauuugcaucuga

SEQ ID NO: 192521 - RNA, 1701 nt, Artificial Sequence; identical to SEQ ID NO: 192098
  derived and/or modified sequence opt5 from hemagglutinin__InfluenzaA__AFN19537

SEQ ID NO: 192522 - RNA, 1701 nt, Artificial Sequence; identical to SEQ ID NO: 192098
  derived and/or modified sequence opt5 from hemagglutinin__InfluenzaA__AFN19539

SEQ ID NO: 192523 - RNA, 1701 nt, Artificial Sequence; identical to SEQ ID NO: 192098
  derived and/or modified sequence opt5 from hemagglutinin__InfluenzaA__AFN19543

SEQ ID NO: 192524 - RNA, 1701 nt, Artificial Sequence
  derived and/or modified sequence opt5 from hemagglutinin__InfluenzaA__AFN19545
augaagaccaucauugcccugagcuacauccucugccugguguucgcucagaaacuucccggcuccgacaacucuacagccacgcugugucucgggcaccaugcggucccuaauggaaccauuguuaagacaaucaccaacgauagaauugaggugacaaaugcuaccgaacuggugcaaaacagcuccaucggcgagaucugcgacucuccgcaccagauucuugauggggaaaauuguacacugaucgacgcccuccugggagauccccagugcgacggcuuuaaaaacaagaaaugggaucuguucgucgagcggagcaaggccuauuccaauuguuacccuuaugacgugcccgauuacgcuucucuccgcagccugguugccuccagcgggacccuugaauuuaacaaugagucuuucaacuggacgggagugacccagaauggcacauccagcgcuugcauuagacggucuaacaauuccuuuuucagccgccugaacuggcucacccaucugaauuuuaaguauccugcccuuaacgucacaaugcccaacaaugagcaauucgacaaacuguacaucuggggcgugcaccauccugggaccgauaaggaccagauuuuucucuaugcgcagucuuccggaagaaucacgguuagcacaaaacggucccagcaagccgugauuccgaacaucggcucucgccccagaauccggaauauuccuagccgcaucuccauuuacuggaccaucgucaagcccggggauauucugcugaucaacagcacaggaaaucucaucgcuccuagaggcuacuucaaaauucagucugggaaguccagcaucaugcggucugacgcccccauuggaaaguguaaaagcgaaugcaucaccccgaacggcuccauuccuaaugacaagcccuuucagaacgugaaucgcaucaccuauggcgcuuguccuagauacgugaaacagucuacacugaaacuugccacggggaugcggaacguccccgagaagcaaacccgcggaaucuucggcgcgauugccggguuuaucgaaaauggaugggagggcaugguugaugggugguauggauucagacaccagaacagcgagggccggggccaggcugccgaccugaaguccacacaagcugccauugaucagaucaaugggaaacucaacagacugauuggaaagaccaaugaaaaguuccaccagaucgagaaagaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaagcagcuucgggaaaacgcggaggauauggggaauggaugcuuuaaaauuuaccacaagugugacaacgccugcaucggcagcauuagaaaugggaccuaugaucaugacguguaccgcgacgaggcucugaacaaucgguuccagaucaaaggcguugaacucaagucuggauacaaagauuggauucuguggaucuccuuugccaucagcugcuuccuucuguguguggcccuccugggcuuuauuaugugggcuugccagaaggggaacaucagauguaauauuugcaucuga

SEQ ID NO: 192525 - RNA, 1701 nt, Artificial Sequence; identical to SEQ ID NO: 192098
  derived and/or modified sequence opt5 from hemagglutinin__InfluenzaA__AFN19547

SEQ ID NO: 192526 - RNA, 1701 nt, Artificial Sequence
  derived and/or modified sequence opt5 from hemagglutinin__InfluenzaA__AFN19549
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccaaaggcgagaucugcaauucuccgcaccagauccuugacgggggaaacuguacacugauugaugcccuccugggcgacccccagugcgauggguuucaaaauaagaaaugggaccuguucgucgaaagaagcaaggcccauuccaacuguuauccuuacgaugugcccgacuaugcuucucuccggagccugguugccuccagcggaacccuugaguuuaauaacgaaucuuucaauuggacgggcgugacccagaacggcacauccagcgcuugcaugcgcagaucuaauaacuccuuuuucagccggcugaauuggcucacccaccugaacuuuaaguacccugcccuuaacgucacaaugcccaauaacgagcaguucgauaaacuguauaucuggggagugcaucacccugggaccgacaaggaucagauuuuucucuacgcgcaagccucuggccgcaucacgguuuccacaaaaagaagccagcaggcugugauuccgaauaucgggucccggccccgcgucagaaacauuccuucucgggugagcaucuauuggaccaucgugaagcccggagacauucugcugaucaauuccacaggcaaccucauugccccucgcggguacuucaaaaucagaagcggaaagucuuccauuaugcggagcgaugcucccaucggcaaguguaauucugccugcaucaccccgaacggcagcauuccuaaugacaaacccuuucagaacgucaaucgcaucaccuacggggcguguccuagauauguuaagcaaaacacacugaaacuugccacgggaaugcggaaugugcccgagaagcagacccgcggcauuuucggggcuaucgccggauuuauugaaaacggcugggaggggaugguggacggaugguacggcuucagacaccaaaauuccgaaggccgggggcaggcugccgaucugaaaucuacacaggccgcuaucgaccagaucaacggaaagcucaacagacugauuggcaaaaccaaugagaaguuccaucagaucgagaaggaauuuagcgaggucgaagggcgcauucaagauaucgagaaauauguggaagacacaaagauugaucuuugguccuacaacgcggagcugcucguugcccuggagaaucagcacaccaucgaccugacggauagcgaaaugaacaaacucuucgagaagaccaaaaagcagcugcgggaaaaugcugaggacaugggaaacggcugcuuuaagauuuaucauaaaugugauaaugccugcaucgggucuaucagaaacggcacauacgaccacgauguguaucgcgacgaagcccuuaauaaccgguuccagauuaagggagucgagcugaaauccggcuacaaggacuggauccucuggauuagcuuugcuaucucuugcuuccugcuuuguguggcccugcucggguuuauuaugugggcgugccaaaaaggaaauaucagauguaacaucugcauuuga

SEQ ID NO: 192527 - RNA, 1701 nt, Artificial Sequence
  derived and/or modified sequence opt5 from hemagglutinin__InfluenzaA__AFN19551
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccauugcgacggcuuucagaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacaaaauggcaccuccagcgcuugcauucgcagaucuaacuccagcuuuuucucucggcuuaauuggcugacacaccucaacuuuaaguauccugcccugaaugucaccaugcccaacaacgagcaguucgacaaacuuuacaucuggggcgugcaucacccugggacggauaaggaccagauuuuucuguaugcgcaguccagcggacgcaucacaguuuccaccaagagaucucaacaggccgugauuccgaauaucggcagccggccccgcaucagaaacauuccuucccggaucagcauuuacuggacaaucgucaaacccggggauauucuccugaucaauucuaccggaaaccugaucgcuccucgcggcuacuucaagauuagauccgggaaaagcucuaucaugcggagcgacgcccccauuggaaaguguaauuccgaaugcaucaccccgaacggcucuauuccuaaugacaagcccuuucagaacgugaaucgcaucacauauggcgcuuguccuagauacgugaaacagagcacgcucaagcuggccaccgggaugcggaacguccccgagaaacaaacacgcggaaucuucggcgcgauugccggguuuaucgaaaauggaugggagggcaugguugaugggugguauggauucagacaccagaacuccgagggccggggccaggcugccgaccuuaagagcacccaagcugccauugaucagaucaaugggaaacugaacagacucauuggaaagacaaaugaaaaauuccaucagaucgagaaggaauuuucugagguggaaggccgcauucaggaccuggagaaguacguggaggauaccaaaaucgaccuuugguccuauaacgccgaacugcucgucgcucuggagaaccaacacacgaucgaucugacagacagcgaaaugaauaaacucuucgagaagaccaagaaacagcugcgggaaaacgcggaggauauggggaauggaugcuuuaagauuuaccauaagugugacaacgccugcaucggcucuauuagaaaugggaccuauaaccacgauguguaccgcgacgaggcucuuaauaaccgguuccagaucaaaggcguugaacugaaguccggauacaaagacuggauucucuggaucagcuuugccaucuccugcuuccugcuuuguguggcccugcucggcuuuauuaugugggcuugccagaaggggaauaucagauguaacauuugcaucuga

SEQ ID NO: 192528 - RNA, 1701 nt, Artificial Sequence; identical to SEQ ID NO: 192477
  derived and/or modified sequence opt5 from hemagglutinin__InfluenzaA__AFN19553

SEQ ID NO: 192529 - RNA, 1701 nt, Artificial Sequence; identical to SEQ ID NO: 192477
  derived and/or modified sequence opt5 from hemagglutinin__InfluenzaA__AFN19555

SEQ ID NO: 192530 - RNA, 1701 nt, Artificial Sequence; identical to SEQ ID NO: 192098
  derived and/or modified sequence opt5 from hemagglutinin__InfluenzaA__AFN19557

SEQ ID NO: 192531 - RNA, 1701 nt, Artificial Sequence; identical to SEQ ID NO: 192477
  derived and/or modified sequence opt5 from hemagglutinin__InfluenzaA__AFN19559

SEQ ID NO: 192532 - RNA, 1701 nt, Artificial Sequence; identical to SEQ ID NO: 192485
  derived and/or modified sequence opt5 from hemagglutinin__InfluenzaA__AFN19561

SEQ ID NO: 192533 - RNA, 1701 nt, Artificial Sequence
  derived and/or modified sequence opt5 from hemagglutinin__InfluenzaA__AFN19563
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucggcuccauucgcaacgggacauaugaucaugacguguaccgggacgaggcucugaauaacagauuccagaucaagggcguugaacucaaaagcggauacaaggauuggauucuguggaucucuuuugccaccuccugcuuccuucuguguguggcccuccugggcuuuaucaugugggcuugccagaaagggaauauucgcuguaacaucugcauuuga

SEQ ID NO: 192534 - RNA, 1701 nt, Artificial Sequence; identical to SEQ ID NO: 192455
  derived and/or modified sequence opt5 from hemagglutinin__InfluenzaA__AFN19565

SEQ ID NO: 192535 - RNA, 1701 nt, Artificial Sequence
  derived and/or modified sequence opt5 from hemagglutinin__InfluenzaA__AFN19567
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauaacuccuuuuucucucgccuuaauuggcugacccaucucaacuuuaaguauccugcccugaacgucacaaugcccaauaacgagcaguucgacaaacuuuacauuuggggcgugcaccauccugggaccgauaaagaccagaucuuucuguaugcgcagagcucuggaagaauuacgguuuccacaaagcggagccaacaggccgugaucccgaauaucggcucccgcccccggauuagaaacaucccuucucgcauuagcaucuacuggaccauugucaaacccggggauauccuccugaucaauuccacaggaaaccugauugcuccuagaggcuacuucaagauccggagcgggaaaucuuccauuaugcgcagcgacgcccccaucggaaaguguaagucugaaugcauuaccccgaauggcagcaucccuaacgacaaacccuuucagaaugugaacagaaucaccuauggcgcuuguccucgguacgugaagcaguccacacucaaacuggccacggggaugcgcaauguccccgagaagcaaaccagaggaauuuucggcgcgaucgccggguuuauugaaaacggaugggagggcaugguugaugggugguauggauuccggcaccaaaauucugagggcagaggccaggcugccgaccuuaaaagcacacaggcugccaucgaucagauuaacgggaagcugaaucgccucaucggaaaaaccaacgaaaaguuccaccagauugagaaggaauuuuccgagguggaaggccggauccaggaccuggagaaauacguggaggauacaaagaucgaccuuuggagcuauaacgccgaacugcucgucgcucuggagaaucaacauaccauugaucugacggacucugaaaugaacaaacucuucgagaagacaaagaagcagcugagagaaaaugcggaggauauggggaacggaugcuuuaagaucuaccacaaaugugacaaugccugcauuggcuccauccgcaacgggaccuaugaucaugacguguaccgggacgaggcucuuaauaacagauuccagauuaagggcguugaacugaaaagcggauacaaggauuggauccucuggaucucuuuugccauuuccugcuuccugcuuuguguggcccugcucggcuuuaucaugugggcuugccagaaagggaauauucgcuguaacaucugcauuuga

SEQ ID NO: 192536 - RNA, 1701 nt, Artificial Sequence; identical to SEQ ID NO: 192098
  derived and/or modified sequence opt5 from hemagglutinin__InfluenzaA__AFN19569

SEQ ID NO: 192537 - RNA, 1701 nt, Artificial Sequence
  derived and/or modified sequence opt5 from hemagglutinin__InfluenzaA__AFN19571
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuauucccaaagcuccggacgcauuacaguuucuaccaagagaagccagcaggcggugaucccgaauauuggcucccggccccgcaucagaaacaucccuagccggauuucuaucuacuggacaauugucaaacccggggauauccugcugauuaauuccaccggaaaccucaucgccccucgcggcuacuucagaauccggagcgggaagucuagcauuaugcgcuccgacgcucccaucggaaaauguaauucugaaugcauuaccccgaacggcagcaucccuaaugacaagcccuuucagaacgugaauagaauuacauauggcccuuguccccgguacgugaagcaauccacgcugaaacuugccaccgggaugcgcaacguccccgagaagcagacaagaggaaucuucggcgcuaucgccggguuuauugaaaauggaugggagggcaugguugaugggugguauggauaccggcaccagaacagcgagggcagaggccaagcggccgaccugaaaucuacccaggcugccaucgaucagauuaaugggaagcucaaccgccugaucggaaaaacaaaugaaaaguuccaccagauugagaaagaguucuccgaaguggaaggccggauccaagaccuugagaaguauguggaggauaccaagauugaccuguggacguacaacgcugaacuccuggucgcccuggagaaccagcauacaaucgaucucaccgacagcgaaaugaauaaacuguuugagaagaccaaaaagcagcuuagagaaaacgccgaggauauggggaauggaugcuucaaaaucuaucacaagugugacaacgcuugcauuggcucuauccgcaaugggacauacaaccaugauguguaccgggacgaggcgcugaauaacagauuucagauuaagggcguugaacucaaauccggauauaaggacuggauccuguggauuagcuucgccaucuccugcuuucuucuguguguggcucuccugggcuucaucaugugggccugccaaaaagggaauauucgcuguaacaucugcauuuga

SEQ ID NO: 192538 - RNA, 1701 nt, Artificial Sequence
  derived and/or modified sequence opt5 from hemagglutinin__InfluenzaA__AFN19573
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcaaaaucugcgacucuccgcaccagauccuugaugggaagaauuguacccugauugacgcccuccugggagauccccagugcgacggcuuucaaaacaaaaagugggaucuguucgucgagagaagcaaggccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaaaaacuccuuuuucagccggcugaauuggcucacacaucugaacuuuaaguauucugcccuuaaugucaccaugccuaacaaagaacaguucgacaagcuguacauuuggggcgugcaccaucccgggacggauaaagaccagaucucccucuaugcgcaagccagcggacgcauuacaguuuccaccaagagaucucagcagacagugaucccuaacauuggcagccggccgcgcgucagaaauauccccucccggaucagcauuuacuggaccaucgugaagccuggggauauucugcugaucaacucuaccggaaaucucauugcuccccgcggcuacuuuaaaaugcaguccggaaagagcucuaucaugagaagcgacgccccuaucgggaaauguaacuccgagugcauuacacccaauggcucuaucccgaacgacaagccuuuccaaaaugugaaccggauuacguauggcgcuuguccccgcuacgucaaacagaauacccugaaacuugccacagggaugagaaacguuccugagaagcagacccggggaaucuuuggcgcgauugccggguucaucgaaaauggaugggagggcaugguggaugggugguauggauuucgccaccaaaacagcgaaggcagaggccaggcugccgaccugaaguccacacaggcugccaucgaucagauuaaugggaagcucaaccggcugaucggaaaaaccaaugagaaguuccaccaaauugagaaagaguucagcgaaguggaaggcagaauccaggaccuugagaaguacgucgaagauacgaaaauugaccuguggucuuauaacgccgagcuccugguggcucuggagaaccagcauacaaucgaucucaccgacuccgaaaugaauaagcuguuugagaagaccaaaaagcagcuucgcgaaaacgcggaggauauggggaauggaugcuucaaaauuuaccacaagugugacaacgccugcaucggcagcauccggaaugggacauaugaucaugacguuuacagagacgaagcucugaacaaucgcuuucaaauuaaaggcguggagcucaagucuggauacaaggauuggauccuguggauuuccuucgccaucagcugcuuucuucugugugucgcccuccugggcuucauuaugugggcuugccagaaagggaacauccgguguaauaucugcauuuga

SEQ ID NO: 192539 - RNA, 1701 nt, Artificial Sequence
  derived and/or modified sequence opt5 from hemagglutinin__InfluenzaA__AFN19575
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacaauccgcaccagauccuugauggggaaaacuguacccugauugacgcccuccugggagauccccagugcgacggcuuucaaaauaaaaagugggaucuguucgucgagagaucuaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcaaagcucuggacgcauuacaguuuccaccaagagaagccagcaggccgugaucccgaauauuggcucccggccccgcgucagaaacaucccuucucggaucagcauuuacuggacaaucgugaaacccggggauauucugcugaucaauuccaccggaaaccucauugcuccucgcggcuacuucaagaucagaagcgggaaaucuuccaucaugcggagcgacgcccccauuggaaaguguaauucugaaugcaucaccccgaacggcagcauuccuaaugacaagcccuuucagaacgugaaucgcaucacauauggcgcuuguccuagauacgucaaacaauccacgcugaagcuggccaccgggaugcggaacguucccgagaaacagacacgcggaauuuucggcgcgaucgccggguuuaucgaaaauggaugggagggcaugguggaugggugguauggauucagacaccagaacucugagggccggggccaagcugccgaccuuaagagcacccaggcugccauugaucagaucaaugggaaacucaacagacugauuggaaagacaaacgaaaaauuccaccagaucgagaaggaauuuuccgagguggaaggccgcauucaagaccuugagaaguacgucgaggauaccaaaaucgaccuguggagcuauaaugccgaacuccugguggcucuggagaaccagcauacgauugaucucacagacucugaaaugaauaagcuguucgagaaaaccaagaaacagcuucgggaaaacgcggaggauauggggaauggaugcuuuaagaucuaccacaagugugacaacgccugcaucggcuccauuagaaaugggaccuaugaucaugacguuuaccgcgacgaggcucugaacaaucgguuccagaucaaaggcguggaacucaagagcggauacaaagauuggauucuguggaucucuuuugccauuuccugcuuccuucugugugucgcccuccugggcuuuaucaugugggcuugccaaaaggggaacaucagauguaauauuugcaucuga

SEQ ID NO: 192540 - RNA, 1701 nt, Artificial Sequence; identical to SEQ ID NO: 192454
  derived and/or modified sequence opt5 from hemagglutinin__InfluenzaA__AFN19577

SEQ ID NO: 192541 - RNA, 1701 nt, Artificial Sequence; identical to SEQ ID NO: 192454
  derived and/or modified sequence opt5 from hemagglutinin__InfluenzaA__AFN19579

SEQ ID NO: 192542 - RNA, 1701 nt, Artificial Sequence; identical to SEQ ID NO: 192454
  derived and/or modified sequence opt5 from hemagglutinin__InfluenzaA__AFN19581

SEQ ID NO: 192543 - RNA, 1701 nt, Artificial Sequence; identical to SEQ ID NO: 192454
  derived and/or modified sequence opt5 from hemagglutinin__InfluenzaA__AFN19583

SEQ ID NO: 192544 - RNA, 1701 nt, Artificial Sequence
  derived and/or modified sequence opt5 from hemagglutinin__InfluenzaA__AFN19587
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauuggcucacacaucugaacuuuaaguauccugcccuuaaugugaccaugcccaacaacgagcaguucgacaagcuguacauuuggggcguucaccauccuggcacggauaaagaccagaucuuucucuaugcgcaauccagcgggcgcauuacaguguccaccaagagaucucagcaggccgucaucccgaauauuggaagccggccccgcaucagaaacaucccuucccggauuagcaucuacuggacaauugugaaacccggcgauauccugcugauuaauucuaccgggaaccucaucgcuccucgcggauacuucaagaucagauccggcaaaagcucuauuaugcggagcgacgcccccaucgggaaguguaauuccgaaugcauuaccccgaacggaucuaucccuaaugacaagcccuuucagaacgugaaucgcauuacauauggcgcuuguccuagauacgucaaacaaagcacgcugaagcuggccaccggcaugcggaacguucccgagaaacagacacgcgggaucuucggagcgaucgccggcuuuauugaaaaugggugggagggaaugguggauggcugguauggguucagacaccagaacuccgagggacggggccaagcugccgaccuuaagagcacccaggcugccaucgaucagauuaauggcaaacucaacagacugaucgggaagacaaaugaaaaauuccaccagauugagaaggaauuuucugagguggaaggacgcauccaagaccuugagaaguacgucgaggauaccaaaauugaccugugguccuauaacgccgaacuccugguggcucuggagaaccagcauacgaucgaucucacagacagcgaaaugaauaagcuguucgagaaaaccaagaaacagcuucgggaaaacgcggaggauaugggcaaugggugcuuuaagaucuaccacgagugugacaacgccugcauuggaucuaucagaaauggcaccuauaaccaugauguuuaccgcgacgaagcucugaauaaccgguuccagauuaaggggguggagcucaaauccggcuacaaggacuggauccuguggauuagcuuugccaucuccugcuuccuucugugugucgcccuccugggauuuaucaugugggcuugccaaaaaggcaauauuagauguaacaucugcauuuga

SEQ ID NO: 192545 - RNA, 1701 nt, Artificial Sequence; identical to SEQ ID NO: 192454
  derived and/or modified sequence opt5 from hemagglutinin__InfluenzaA__AFN19589

SEQ ID NO: 192546 - RNA, 1701 nt, Artificial Sequence
  derived and/or modified sequence opt5 from hemagglutinin__InfluenzaA__AFN19591
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcaugcgcagaagcaauucuuccuuuuucagccggcugaacuggcucacccaucugaauuuuaaguauccugcccuuaacgucacaaugcccaacaaugagcaguucgacaagcuguacauuuggggcgugcaccauccugggaccgauaaagaccagaucuuucucuaugcgcaaucuuccggacgcauuacgguuagcacaaagagaucccagcaggccgugaucccgaacauuggcucucggccccgcaucagaaauaucccuagccggauuuccaucuacuggaccauugucaaacccggggauauccugcugauuaacagcacaggaaaucucaucgcuccucgcggcuacuucaagaucagaucugggaaauccagcauuaugcggucugacgcccccaucggaaaguguaacagcgaaugcauuaccccgaauggcuccaucccuaacgacaagcccuuucagaaugugaaccgcauuaccuauggcgcuuguccuagauacgugaaacaaucuacacugaaacuugccacggggaugcggaauguccccgagaagcagacccgcggaaucuucggcgcgaucgccggguuuauugaaaacggaugggagggcaugguugaugggugguauggauucagacaccagaauagcgagggccggggccaagcugccgaccugaaguccacacaggcugccaucgaucagauuaacgggaaacucaauagacugaucggaaagaccaacgaaaaauuccaccagauugagaaggaauuuagcgagguggaaggccgcauccaagaccuugagaaguacguggaggauacaaaaauugaccuguggucuuauaacgccgaacuccuggucgcucuggagaaucagcauaccaucgaucucacggacuccgaaaugaacaagcuguucgagaaaacaaagaaacagcuucgggaaaaugcggaggauauggggaacggaugcuuuaagaucuaccacaagugugacaaugccugcauuggcagcaucagaaacgggaccuaugaucaugacguguaccgcgacgaggcucugaauaaccgguuccagauuaaaggcguugaacucaagucuggauacaaagauuggauccuguggauuuccuuugccaucagcugcuuccuucuguguguggcccuccugggcuuuaucaugugggcuugccaaaaugggaacauuagauguaauaucugcauuuga

SEQ ID NO: 192547 - RNA, 1701 nt, Artificial Sequence; identical to SEQ ID NO: 192454
  derived and/or modified sequence opt5 from hemagglutinin__InfluenzaA__AFN19593

SEQ ID NO: 192548 - RNA, 1701 nt, Artificial Sequence; identical to SEQ ID NO: 192455
  derived and/or modified sequence opt5 from hemagglutinin__InfluenzaA__AFN19595

SEQ ID NO: 192549 - RNA, 1701 nt, Artificial Sequence; identical to SEQ ID NO: 192455
  derived and/or modified sequence opt5 from hemagglutinin__InfluenzaA__AFN19599

SEQ ID NO: 192550 - RNA, 1701 nt, Artificial Sequence; identical to SEQ ID NO: 192517
  derived and/or modified sequence opt5 from hemagglutinin__InfluenzaA__AFN19601

SEQ ID NO: 192551 - RNA, 1701 nt, Artificial Sequence; identical to SEQ ID NO: 192098
  derived and/or modified sequence opt5 from hemagglutinin__InfluenzaA__AFN19607

SEQ ID NO: 192552 - RNA, 1701 nt, Artificial Sequence; identical to SEQ ID NO: 192454
  derived and/or modified sequence opt5 from hemagglutinin__InfluenzaA__AFN19609

SEQ ID NO: 192553 - RNA, 1701 nt, Artificial Sequence
  derived and/or modified sequence opt5 from hemagglutinin__InfluenzaA__AFN19611
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcagaagcaauaacuccuuuuucucucggcugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcaaagcucuggacgcaucacgguuuccacaaagagaagccagcaggccgugauuccgaauaucggcucccggccccgcaucagaaacauuccuucucggaucagcauuuacuggaccaucgucgaacccggggauauucugcugaucaauuccacaggaaaccucaucgcuccucgcggcuacuucaaaauuagaagcgggaagucuuccaucaugcggagcgacgcccccauuggaaaauguaauucugagugcaucaccccgaacggcagcauuccuaaugacaagcccuuucagaacgugaaucgcaucaccuauggcgcuuguccuagauacgugaagcaauccacacugaaacuugccacggggaugcggaacguccccgaaaagcagacccgcggaaucuucggcgcgauugccggguuuaucgagaauggaugggagggcaugguugaugggugguauggauucagacaccagaacucugaaggccggggccaagcugccgaccugaaaagcacacaggcugccauugaucagaucaaugggaagcucaacagacugauuggaaaaaccaacgagaaguuccaccagaucgaaaaagaguuuuccgaaguggagggccgcauucaagaccuugagaaguacguggaagauacaaagaucgaccuguggagcuauaaugccgagcuccuggucgcucuggaaaaccagcauaccaucgaucucacggacucugagaugaauaaacuguucgaaaagaccaaaaagcagcuucgggagaacgcggaggauauggggaauggaugcuuuaaaauuuaccacaagugugacaacgccugcaucggcuccauuagaaaugggacauaugaucaugacguguaccgcgacgaagcucugaacaaucgguuccagaucaagggcguugagcucaaaagcggauacaaggauuggauucuguggaucucuuuugccaucuccugcuuccuucuguguguggcccuccugggcuuuauuaugugggcuugccaaaaagggaacaucagauguaauauuugcaucuga

SEQ ID NO: 192554 - RNA, 1701 nt, Artificial Sequence; identical to SEQ ID NO: 192477
  derived and/or modified sequence opt5 from hemagglutinin__InfluenzaA__AFN19613

SEQ ID NO: 192555 - RNA, 1701 nt, Artificial Sequence; identical to SEQ ID NO: 192455
  derived and/or modified sequence opt5 from hemagglutinin__InfluenzaA__AFN19617

SEQ ID NO: 192556 - RNA, 1701 nt, Artificial Sequence
  derived and/or modified sequence opt5 from hemagglutinin__InfluenzaA__AFN19619
augaagaccaucauugcccugagccacauccucugccugguguucgcucagaaacuucccggcaacgacaauuccacagccacgcugugucucgggcaucacgcggucccuaacggaaccauuguuaagacaaucaccaaugaucaaauugaggugacaaacgcuaccgaacuggugcagucuagcuccacaggcgagaucugcgacucuccgcaucagauccuugauggggaaaauuguacccugauugacgcccuccugggagauccccagugcgacggcuuucaaaacaaaaagugggaucuguucgucgagagaagcaaagccuacuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaccugaacuuuaaguacccugcccuuaaugucaccaugcccaacaacgagcaguucgacaagcuguauauuuggggcgugcaucacccugggacggauaaagaccagaucuuucucuacgcgcaauccagcggacgcauuacaguuuccaccaagagaucucagcaggccgugaucccgaauauuggcagcaaaccccggauccgcaacaucccuuccagaauuagcaucuauuggacaauugucaagcccggggauauccugcugauuaauucuaccggaaaccucaucgcuccucggggcuacuucaaaauccgcuccggaaagagcucuauuaugagaagcgacgcccccaucgggaaguguaauuccgaaugcauuaccccgaacggcucuaucccuaaugacaaacccuuucagaacgugaaucggauuacauacggcgcuuguccucgcuaugugaagcaaagcacgcugaaacuugccaccgggaugagaaacguccccgagaagcagacacggggaaucuucggcgcgaucgccggguuuauugaaaauggaugggagggcaugguugaugggugguacggauuccgccaccagaacuccgagggcagaggccaagcugccgaccugaaaagcacccaggcugccaucgaucagauuaaugggaagcucaaccggcugaucggaaaaacaaaugaaaaguuccaucagauugagaaggaauuuucugagguggaaggcagaauccaagaccuugagaaauauguggaggauaccaagauugaccugugguccuacaacgccgaacuccuggucgcucuggagaaccagcacacgaucgaucucacagacagcgaaaugaauaaacuguucgagaagaccaaaaagcagcuucgcgaaaacgcggaggauauggggaauggaugcuuuaagaucuaucauaaaugugacaacgccugcauuggcucuauccggaaugggaccuacaaccacgauguguauagagacgaggcucugaauaaccgcuuccagauuaagggcguugaacucaaauccggauacaaggacuggauccuguggauuagcuuugccaucuccugcuuccuucugugugugguccuccugggcuuuaucaugugggccugccaaaaagggaauauucgguguaacaucugcauuuga

SEQ ID NO: 192557 - RNA, 1701 nt, Artificial Sequence; identical to SEQ ID NO: 192517
  derived and/or modified sequence opt5 from hemagglutinin__InfluenzaA__AFN19623

SEQ ID NO: 192558 - RNA, 1701 nt, Artificial Sequence; identical to SEQ ID NO: 192454
  derived and/or modified sequence opt5 from hemagglutinin__InfluenzaA__AFN19629

SEQ ID NO: 192559 - RNA, 1701 nt, Artificial Sequence
  derived and/or modified sequence opt5 from hemagglutinin__InfluenzaA__AFN19631
augaagaccaucauugcccugagcuacauccucugccugguguucgcucagaaacuucccgagaacgacuauuccacagccacgcugugucucggccaccaugcggucccuaaugggaccauuguuaagacaaucaccaacgaucaaauugaagugacaaaugcuaccgagcuggugcagucuagcuccacaggagaaaucugcgacucuccgcaccagauccuugauggcauuaacuguacccugaucgacgcccuccugggggauccccagugcgacggauuucaaaauaaaaagugggaucuguucgucgagagaagcaaagccuacuccaacuguuauccuuacgacgugcccgauuaugcuucucuccggagccugguugccuccagcggcacgcuugaauuuaauaacgagucuuucaauuggaccggggugacacagaacggaaccuccagcgcuugcauucgcagaucuacauccagcuuuuucucucggcugaauuggcucacccaucugaacuuuaaguacccugcccuuaaugucacgaugcccaacaaugagcaguucgacaagcuguauaucuggggcgugcaccauccuggcacagauaaagaccagauuuuucucuacgcgcaaccguccgggcgcaucaccguuagcacaaagagaucccagcaggccgugauucccaacaucggaucucggccucgcaucagaaacauucccagccggaucuccauuuacuggaccaucgucaaaccuggcgauauucugcugaucaauagcaccgggaaccucaucgcuccccgcggauauuucaagauuagaucuggcaaauccagcaucaugcggucugacgccccgauugggaaguguaauagcgaaugcaucacaccuaacggauccauucccaaugacaagccuuuucagaacgugaaucgcaucacguacggcgcuugucccagauaugugaaacaaucuacccugaaacuugccacaggcaugcggaacguccccgagaagcagacccgcgggaucuucggagcgauugccggcuuuaucgaaaaugggugggagggaaugguugauggcugguacggguucagacaccagaacagcgagggacggggccaagcugccgaccugaaguccacacaggcugccauugaucagaucaauggcaaacucaacagacugauugggaagaccaaugaaaaauuccaccagaucgagaaggaauuuagcgagguggaaggacgcauucaagaccuugagaaguauguggaggauacgaaaaucgaccuguggucuuacaacgccgaacuccuggucgcucuggagaaucagcauacaaucgaucucaccgacuccgaaaugaacaagcuguucgagaaaaccaagaaacagcuucgggaaaacgcggaggauaugggcaaugggugcuuuaagauuuaucacaagugugacaacgccugcaucggaagcauuagaaauggcacauacaaccaugauguguaccgcgacgaggcucugaauaaccgguuccagaucaaagggguugaacucaagucuggcuauaaagacuggauucuguggaucuccuuugccaucagcugcuuccuucuguguguggcccuccugggauuuauuaugugggcuugccaaaagggcaauaucagauguaacauuugcaucuga

SEQ ID NO: 192560 - RNA, 1701 nt, Artificial Sequence
  derived and/or modified sequence opt5 from hemagglutinin__InfluenzaA__AFN19633
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaaucuccaccaagagaucucagcaggccguuauuccgaauaucggcagccggccccgcaucagaaacauuccuucccggaucagcauuuacuggacaaucgugaaacccggggauauucugcugaucaauucuaccggaaaccucaucgcuccucgcggcuacuucaagauuagauccgggaaaagcucuaucaugcggagcgacgcccccauuggaaaguguaauuccgaaugcaucaccccgaacggcucuauuccuaaugacaagcccuuucagaacgucaaucgcaucacauauggcgcuuguccuagauacgugaaacaaagcacgcugaagcuggccaccgggaugcggaacgugcccgagaaacagacacgcggaaucuucggcgcgauugccggguuuaucgaaaauggaugggagggcauggucgaugggugguauggauucagacaccagaacuccgagggccggggccaagcugccgaccuuaagagcacccaggcugccauugaucagaucaaugggaaacucaacagacugauuggaaagacaaaugaaaaauuccaccagaucgagaaggaauuuucugagguugaaggccgcauucaagaccuugagaaguacguggaggauaccaaaaucgaccugugguccuauaacgccgaacuccugguggcucuggagaaccagcauacgaucgaucucacagacagcgaaaugaauaagcuguucgagaaaaccaagaaacagcuucgggaaaacgcggaggauauggggaauggaugcuuuaagauuuaccacaagugugacaacgccugcaucggcucuauuagaaaugggaccuauaaccaugaugucuaccgcgacgaggcucugaauaaccgguuccagaucaaaggcguggaacucaaguccggauacaaagacuggauucuguggaucagcuuugccaucuccugcuuccuucuguguguugcccuccugggcuuuauuaugugggcuugccaaaaggggaauaucagauguaacauuugcaucuga

SEQ ID NO: 192561 - RNA, 1701 nt, Artificial Sequence
  derived and/or modified sequence opt5 from hemagglutinin__InfluenzaA__AFN19635
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcauuaauuguacccugaucgacgcccuccugggggauccccagugcgacggauuucaaaacaaaaagugggaucuguucgucgagagaagcaaagccuauuccaauuguuacccuuaugacgugcccgauuacgcuucucuccggagccugguugccuccagcggcacgcuugaauuuaacaaugagucuuucaacuggaccggggugacacagaauggaaccuccagcgcuugcauucgcagaucuaacuccagcuuuuucucucggcugaauuggcucacacaucugaacuuuaaguauccugcccuuaaugucaccaugcccaacaacgagcaguucgacaagcuguacaucuggggcgugcaccauccuggcacggauaaagaccagauuuuucucuaugcgcaaccguccgggcgcaucacaguuagcaccaagagaucccagcaggccgugauucccaauaucggaucucggccucgcaucagaaacauucccagccggaucuccauuuacuggacaaucgucaaaccuggcgauauucugcugaucaauagcaccgggaaccucaucgcuccccgcggauacuucaagauuagaucuggcaaauccagcaucaugcggucugacgccccgauugggaaguguaauagcgaaugcaucaccccuaacggauccauucccaaugacaagccuuuucagaacgugaaucgcaucacauauggcgcuugucccagauacgugaaacaaucuacgcugaaacuugccaccggcaugcggaacguccccgagaagcagacacgcgggaucuucggagcgauugccggcuuuaucgaaaaugggugggagggaaugguugauggcugguauggguucagacaccagaacagcgagggacggggccaagcugccgaccugaaguccacccaggcugccauugaucagaucaauggcaaacucaacagacugauugggaagacaaaugaaaaauuccaccagaucgagaaggaauuuagcgagguggaaggacgcauucaagaccuugagaaguacguggaggauaccaaaaucgaccuguggucuuauaacgccgaacuccuggucgcucuggagaaccagcauacgaucgaucucacagacuccgaaaugaauaagcuguucgagaaaaccaagaaacagcuucgggaaaacgcggaggauaugggcaaugggugcuuuaagauuuaccacaagugugacaacgccugcaucggaagcauuagaaauggcaccuauaaccaugauguguaccgcgacgaggcucugaauaaccgguuccagaucaaagggguugaacucaagucuggcuacaaagacuggauucuguggaucuccuuugccaucagcugcuuccuucuguguguggcccuccugggauuuauuaugugggcuugccaaaagggcaauaucagauguaacauuugcaucuga

SEQ ID NO: 192562 - RNA, 1701 nt, Artificial Sequence; identical to SEQ ID NO: 192561
  derived and/or modified sequence opt5 from hemagglutinin__InfluenzaA__AFN19637

SEQ ID NO: 192563 - RNA, 1701 nt, Artificial Sequence; identical to SEQ ID NO: 192098
  derived and/or modified sequence opt5 from hemagglutinin__InfluenzaA__AFN19639

SEQ ID NO: 192564 - RNA, 1701 nt, Artificial Sequence; identical to SEQ ID NO: 192517
  derived and/or modified sequence opt5 from hemagglutinin__InfluenzaA__AFN19641

SEQ ID NO: 192565 - RNA, 1701 nt, Artificial Sequence; identical to SEQ ID NO: 192561
  derived and/or modified sequence opt5 from hemagglutinin__InfluenzaA__AFN19643

SEQ ID NO: 192566 - RNA, 1701 nt, Artificial Sequence; identical to SEQ ID NO: 192098
  derived and/or modified sequence opt5 from hemagglutinin__InfluenzaA__AFN19645

SEQ ID NO: 192567 - RNA, 1701 nt, Artificial Sequence
  derived and/or modified sequence opt5 from hemagglutinin__InfluenzaA__AFN19647
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggagaaaucugcgacucuccgcaccagauccuugauggcgucaauuguacccugauugacgcccuccugggggauccccagugcgacggauuucaaaacaaaaagugggaucuguucguggagagaagcaaagccuauuccaauuguuacccuuaugacguucccgauuacgcuucucucaagagccugguggccuccagcggcacgcuugaauuuaacaaugagucuuucaacuggaccggggucacacagaauggaaccuccagcgcuugcauccggcgcucuaacuccagcuuuuucucuagacugaauuggcucacacaucugaacuuuaaguauccugcccuuaaugugaccaugcccaacaacgagcaguucgacaaacuguacauuuggggcguucaccauccuggcacggauaaggaccagaucuuucucuaugcgcaauccagcgggcggauuacaguguccaccaaacgcucucagcaggccgucaucccgaauauuggaagcagaccccggauccgcaacaucccuuccagaauuagcaucuacuggacaauugugaagcccggcgauauccugcugauuaauucuaccgggaaccucaucgcuccucggggauacuucaaaauccaguccggcaagagcucuauuaugcgcagcgacgcccccaucgggaaguguaauuccgaaugcauuaccccgaacggaucuaucccuaaugacaaacccuuucaaaacgugaauagaauuacauauggcgcuuguccucgguacgucaagcagagcacgcugaaacuugccaccggcaugcgcaacguucccgagaagcagacaagagggaucuucggagcgaucgccggcuuuauugaaaaugggugggagggaaugguggauggcugguauggguuccggcaccaaaacuccgagggacgcggccaggcugccgaccugaaaagcacccaggcugccaucgaucagauuaauggcaagcucaacagacugaucgggaaaacaaaugaaaaguuccaccaaauugagaaggaauuuucugagguggaaggacggauccaggaccuugagaaauacgucgaggauaccaagauugaccugugguccuauaacgccgaacuccugguggcucuggagaaccagcauacgaucgaucucacagacagcgaaaugaauaaacuguucgagaagaccaaaaagcagcuuagagaaaacgcggaggauaugggcaaugggugcuuuaagaucuaccacaaaugugacaacgccugcauuggaucuauccgcaauggcaccuauaaccaugauguuuaccgggacgaggcucugaauaacagauuccaaauuaaggggguggaacucaaauccggcuacaaggacuggauccuguggauuagcuuugccaucuccugcuuccuucugugugucgcccuccugggauuuaucaugugggcuugccagaaaggcaauauucgcuguaacaucugcauuuga

SEQ ID NO: 192568 - RNA, 1701 nt, Artificial Sequence
  derived and/or modified sequence opt5 from hemagglutinin__InfluenzaA__AFN19649
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucuccgagaucugcgacucuccgcaccagauucuugauggcgaaaacuguacacugaucgacgcccuccugggggauccccagugcgacggauuucagaauaaaaagugggaucuguucgucgagagaagcaaagccuauuccaacuguuacccuuaugacgugcccgauuacgcuucucuccggagccugguugccuccagcggcacccuugaauuuaauaacgagucuuucaauuggacgggggugacccagaacggaacauccagcgcuugcauucgcagaucuaauuccagcuuuuucucucggcugaacuggcucacccaucugaauuuuaaguauccugcccuuaacgucacaaugcccaacaaugagcaguucgacaagcuguacaucuggggcgugcaccauccuggcaccgauaaagaccagauuuuucucuaugcgcaauccagcgggcgcaucacgguuuccacaaagagaucucagcaggccgugauuccgaacaucggaagccggccccgcaucagaaauauuccuucccggaucagcauuuacuggaccaucgucaaacccggcgauauucugcugaucaacucuacagggaaucucaucgcuccucgcggauacuucaagauuagauccggcaaaagcucuaucaugcggagcgacgcccccauugggaaguguaacuccgaaugcaucaccccgaauggaucuauuccuaacgacaagcccuuucagaaugugaaccgcaucaccuauggcgcuuguccuagauacgugaaacaaagcacacugaagcuggccacgggcaugcggaauguccccgagaaacagacccgcgggaucuucggagcgauugccggcuuuaucgaaaacgggugggagggaaugauggauggcugguauggguucagacaccaaaauuccgagggacggggccaggcugccgaccuuaagagcacacaggcugccauugaucagaucaacggcaaacucaauagacugauugggaagaccaacgaaaaauuccaccagaucgagaaggaauuuucugagguugaaggacgcauucaagaccuugagaaguacguggaggauacaaaaaucgaccugugguccuauaacgccgaacuccugguggcucuggagaaucagcauaccaucgaucucacggacagcgaaaugaacaagcuguucgagaaaacaaagaaacagcuucgggaaaaugcggaggauaugggcaacgggugcuuuaagauuuaccacaagugugacaaugccugcaucggaucuauuagaaacggcaccuaugaucaugacgucuaccgcgacgaggcucugaauaaccgguuccagaucaaagggguggaacucaaguccggcuacaaagauuggauucuguggaucagcuuugccaucuccugcuuccuucuguguguugcccuccugggauuuauuaugugggcuugccaaaagggcaauaucagauguaacauuugcaucuga

SEQ ID NO: 192569 - RNA, 1701 nt, Artificial Sequence; identical to SEQ ID NO: 192561
  derived and/or modified sequence opt5 from hemagglutinin__InfluenzaA__AFN19653

SEQ ID NO: 192570 - RNA, 1701 nt, Artificial Sequence; identical to SEQ ID NO: 192477
  derived and/or modified sequence opt5 from hemagglutinin__InfluenzaA__AFN19663

SEQ ID NO: 192571 - RNA, 1701 nt, Artificial Sequence; identical to SEQ ID NO: 192485
  derived and/or modified sequence opt5 from hemagglutinin__InfluenzaA__AFN19665

SEQ ID NO: 192572 - RNA, 1701 nt, Artificial Sequence
  derived and/or modified sequence opt5 from hemagglutinin__InfluenzaA__AFN19667
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcaugcgcagaagcaauucuuccuuuuucagccggcugaacuggcucacccaucugaauuuuaaguauccugcccuuaacgucacaaugcccaacaaugagcaguucgacaagcuguacauuuggggcgugcaccauccugggaccgauaaagaccagaucuuucucuaugcgcaaucuuccggacgcauuacgguuagcacaaagagaucccagcaggccgugaucccgaacauuggcucucggccccgcaucagaaauaucccuagccggauuuccaucuacuggaccauugucaaacccggggauauccugcugauuaacagcacaggaaaucucaucgcuccucgcggcuacuucaagaucagaucugggaaauccagcauuaugcggucugacgcccccaucggaaaguguaacagcgaaugcauuaccccgaauggcuccaucccuaacgacaagcccuuucagaaugugaaccgcauuaccuauggcgcuuguccuagauacgugaaacaaucuacacugaaacuugccacggggaugcggaauguccccgagaagcagacccgcggaaucuucggcgcgaucgccggguuuauugaaaacggaugggagggcaugguugaugggugguauggauucagacaccagaauagcgagggccggggccaagcugccgaccugaaguccacacaggcugccaucgaucagauuaacgggaaacucaauagacugaucggaaagaccaacgaaaaauuccaccagauugagaaggaauuuagcgagguggaaggccgcauccaagaccuugagaaguacguggaggauacaaaaauugaccuguggucuuauaacgccgaacuccuggucgcucuggagaaucagcauaccaucgaucucacggacuccgaaaugaacaagcuguucgagaaaacaaagaaacagcuucgggaaaaugcggaggauauggggaacggaugcuuuaagaucuaccacaagugugacaaugccugcauuggcagcaucagaaacgggaccuaugaucaugacguguaccgcgacgaggcucugaauaaccgguuccagauuaaaggcguugaacucaagucuggauacaaagauuggauccuguggauuuccuuugccaucagcugcuuccuucuguguguggcccuccugggcuuuaucaugugggcuugccaaaaggggaauauuagauguaacaucugcauuuga

SEQ ID NO: 192573 - RNA, 1701 nt, Artificial Sequence
  derived and/or modified sequence opt5 from hemagglutinin__InfluenzaA__AFN19669
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcaaaauucuagcaucggcgagaucugcgacuccccgcaccagauucuggauggggaaaacuguacacuuaucgacgcccugcucggagauccccagugcgacggcuuucagaauaaaaagugggaucuguucgucgagagaucuaaagccuauagcaacuguuacccuuaugacgugcccaauuacgcuucccugcggucucucguugccagcuccgggacccuggaauuuaacaaugagagcuucaacuggacgggagugacccagaauggcacaucuuccgcuugcaugcgcagaagcaacucuuccuuuuucagccggcuuaauuggcugacccaucucaacuuuaaguauccugcccugaacgucacaaugcccaauaacgagcaguucgauaaacuuuacauuuggggcgugcaccauccugggaccgacaaggaucagaucuuucuguaugcgcaaucuuccggacgcauuacgguuagcacaaagagaucccagcaggccgugaucccgaauauuggcucucggccccgcaucagaaacaucccuagccggauuuccaucuacuggaccauugucaaacccggggacauccuccugauuaauagcacaggaaaccugaucgcuccucgcggcuacuucaagaucagaucugggaaauccagcauuaugcggucugaugcccccaucggaaaguguaauagcgaaugcauuaccccgaacggcuccaucccuaaugacaagcccuuucagaacgugaaucgcauuaccuauggcgcuuguccuagauacgugaaacaaucuacacucaagcuggccacggggaugcggaacguccccgagaaacagacccgcggaaucuucggcgcgaucgccggguuuauugaaaauggaugggagggcaugguugacgggugguauggauucagacaccagaacagcgagggccggggccaagcugccgaucuuaaguccacacaggcugccaucgaccagauuaaugggaaacugaacagacucaucggaaagaccaacgaaaaauuccaccagauugagaaggaauuuagcgagguggaaggccgcauccaagaucuggagaaguacguggaggacacaaaaauugaucuuuggucuuauaaugccgaacugcucgucgcucuggagaaccagcauaccaucgaccugacggauuccgaaaugaauaaacucuucgagaagacaaagaaacagcugcgggaaaacgcggaggacauggggaauggaugcuuuaagaucuaccacaagugugauaacgccugcauuggcagcaucagaaaugggaccuaugaccaugauguguaccgcgacgaggcucuuaacaaucgguuccagauuaaaggcguugaacugaagucuggauacaaagacuggauccucuggauuuccuuugccaucagcugcuuccugcuuuguguggcccugcucggcuuuaucaugugggcuugccaaaaggggaacauuagauguaauaucugcauuuga

SEQ ID NO: 192574 - RNA, 1701 nt, Artificial Sequence
  derived and/or modified sequence opt5 from hemagglutinin__InfluenzaA__AFN19671
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauaacuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacaaacccuuucagaaugugaacagaaucaccuauggcgcuuguccucgguacgugaagcaguccacacugaaacuugccacggggaugcgcaauguccccgagaagcaaaccagaggaaucuucggcgcgauugccggguuuaucgaaaacggaugggagggcaugguugaugggugguauggauuccggcaccaaaauucugagggcagaggccaggcugccgaccugaaaagcacacaggcugccauugaucagaucaacgggaagcucaaucgccugauuggaaaaaccaacgaaaaguuccaccagaucgagaaggaauuuuccgagguggaaggccggauucaggaccuugagaaauacguggaggauacaaagaucgaccuguggagcuauaacgccgaacuccuggucgcucuggagaaucaacauaccaucgaucucacggacucugaaaugaacaaacuguucgagaagaccaaaaagcagcuuagagaaaaugcggaggauauggggaacggaugcuuuaagauuuaccacaaaugugacaaugccugcaucgaguccauucgcaacggcacauaugaucaugacguguaccgggacgaagcucugaauaacagauuccagaucaaggggguugagcucaaaagcggcuacaaggauuggauucuguggaucucuuuugccaucuccugcuuccuucuguguguggcccuccugggauuuauuaugugggcuugccagaaaggcaauauccgcuguaacauuugcaucuga

SEQ ID NO: 192575 - RNA, 1701 nt, Artificial Sequence; identical to SEQ ID NO: 192098
  derived and/or modified sequence opt5 from hemagglutinin__InfluenzaA__AFN19674

SEQ ID NO: 192576 - RNA, 1701 nt, Artificial Sequence; identical to SEQ ID NO: 192098
  derived and/or modified sequence opt5 from hemagglutinin__InfluenzaA__AFN19676

SEQ ID NO: 192577 - RNA, 1701 nt, Artificial Sequence; identical to SEQ ID NO: 192485
  derived and/or modified sequence opt5 from hemagglutinin__InfluenzaA__AFN19678

SEQ ID NO: 192578 - RNA, 1701 nt, Artificial Sequence
  derived and/or modified sequence opt5 from hemagglutinin__InfluenzaA__AFN19682
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccaauuacgcuucccuccggucucugguugccagcuccgggacccuugaauuuaacaaugagagcuucaacuggacgggagugacccagaauggcacaucuuccgcuugcaugcgcagaagcaacucuuccuuuuucagccggcugaauuggcucacccaucugaacuuuaaguauccugcccuuaacgucacaaugcccaauaacgagcaguucgauaagcuguacauuuggggcgugcaccauccugggaccgacaaagaucagaucuuucucuaugcgcaaucuuccggacgcauuacgguuagcacaaagagaucccagcaggccgugaucccgaauauuggcucucggccccgcaucagaaacaucccuagccggauuuccaucuacuggaccauugucaaacccggggacauccugcugauuaauagcacaggaaaccucaucgcuccucgcggcuacuucaagaucagaucugggaaauccagcauuaugcggucugaugcccccaucggaaaguguaauagcgaaugcauuaccccgaacggcuccaucccuaaugacaagcccuuucagaacgugaaucgcauuaccuauggcgcuuguccuagauacgugaaacaaucuacacugaaacuugccacggggaugcggaacguccccgagaagcagacccgcggaaucuucggcgcgaucgccggguuuauugaaaauggaugggagggcaugguugacgggugguauggauucagacaccagaacagcgagggccggggccaagcugccgaucugaaguccacacaggcugccaucgaccagauuaaugggaaacucaacagacugaucggaaagaccaacgaaaaauuccaccagauugagaaggaauuuagcgagguggaaggccgcauccaagaucuugagaaguacguggaggacacaaaaauugaucuguggucuuauaaugccgaacuccuggucgcucuggagaaccagcauaccaucgaccucacggauuccgaaaugaauaagcuguucgagaaaacaaagaaacagcuucgggaaaacgcggaggacauggggaauggaugcuuuaagaucuaccacaagugugauaacgccugcauuggcagcaucagaaaugggaccuaugaccaugauguguaccgcgacgaggcucugaacaaucgguuccagauuaaaggcguugaacucaagucuggauacaaagacuggauccuguggauuuccuuugccaucagcugcuuccuucuguguguggcccuccugggcuuuaucaugugggcuugccaaaaggggaacauuaaauguaauaucugcauuuga

SEQ ID NO: 192579 - RNA, 1701 nt, Artificial Sequence
  derived and/or modified sequence opt5 from hemagglutinin__InfluenzaA__AFN19684
augaagaccaucauugcccugagcuacauccucugccuggcuuucgcccagaaacuucccggcaacgacaauuccacagcgacgcugugucucgggcaccaugcugugccuaacggaaccauugucaagacaaucaccaaugaucaaauugagguuacaaacgccaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucguggagagaagcaaggcuuauuccaauuguuacccuuaugacguccccgauuacgccucucuccggagccugguggcuuccagcgggacgcuugaauuuaacaaugagucuuucaacuggaccggaguuacacagaauggcaccuccagcgccugcauccgcggcucuaacuccagcuuuuucucuagacugaauuggcucacacaucugaacuuuaaguauccugcgcuuaaugugaccaugcccaacaacgagcaguucgacaagcuguacauuuggggaguccaccauccugggacggauaaagaccagaucuuucucuaugcccaauccagcggccggauuacaguguccaccaagcgcucucagcaggcuguuaucccgaauauugggagcagaccccggauccgcaacaucccuuccagaauuagcaucuacuggacaauugugaaacccggagauauccugcugauuaauucuaccggcaaccucaucgccccucggggguacuucaagauccgcuccggaaaaagcucuauuaugagaagcgacgcucccaucggcaaguguaauuccgaaugcauuaccccgaacggcucuaucccuaaugacaagcccuuucagaacgucaaucggauuacauauggggccuguccucgcuacgugaaacaaagcacgcugaaacuugcgaccggaaugagaaacgugcccgagaaacagacacggggcaucuucggggccaucgcuggauuuauugaaaauggcugggaggggauggucgauggaugguauggcuuccgccaccagaacuccgagggcagagggcaagccgcugaccucaagagcacccaggccgccaucgaucagauuaauggaaaacugaaccggcugaucggcaagacaaaugaaaaauuccaccagauugagaaggaauuuucugagguugaagggagaauccaagaccuugagaaguacguggaggauaccaaaauugaccugugguccuauaacgcugaacuccugguggcgcuggagaaccagcauacgaucgaucucacagacagcgaaaugaauaagcuguucgagaaaaccaagaaacagcuucgcgaaaacgccgaggauaugggaaauggcugcuuuaagaucuaccacaagugugacaacgcuugcauugggucuauccggaauggcaccuauaaccauaaugucuacagagaugaggcccugaacaaucgcuuccagauuaaaggaguggaacucaaguccggcuacaaagacuggauccuguggauuagcuuugccaucuccugcuuccuucuguguguugcucuccugggguuuaucaugugggccugccaaaagggaaacauucgguguaauaucugcauuuga

SEQ ID NO: 192580 - RNA, 1701 nt, Artificial Sequence
  derived and/or modified sequence opt5 from hemagglutinin__InfluenzaA__AFN19686
augaagaccaucauugcccugagcuacauccucugccuggcuuucgcccagaaacuucccggcaacgacaauuccacagcgacgcugugucucgggcaccaugcugugccuaacggaaccauugucaagacaaucaccaaugaucaaauugagguuacaaacgccaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucguggagagaagcaaggcuuauuccaauuguuacccuuaugacguccccgauuacgccucucuccggagccugguggcuuccagcgggacgcuugaauuuaacaaugagucuuucaacuggaccggaguuacacagaauggcaccuccagcgccugcauccgcagaucuaacuccagcuuuuucucucggcugaauuggcucacacaucugaacuuuaaguauccugcgcuuaaugugaccaugcccaacaacgagcaguucgacaagcuguacauuuggggcguccaccauccugggacggauaaagaccagaucuuucucuaugcccaauccagcggacgcauuacaguguccaccaagagaucucagcaggcuguuaucccgaauauuggcagccggccccgcaucagaaacaucccuucccggauuagcaucuacuggacaauugugaaacccggggauauccugcugauuaauucuaccggaaaccucaucgccccucgcggcuacuucaagaucagauccgggaaaagcucuauuaugcggagcgacgcucccaucggaaaguguaauuccgaaugcauuaccccgaacggcucuaucccuaaugacaagcccuuucagaacgucaaucgcauuacauauggcgccuguccuagauacgugaaacaaagcacgcugaaacuugcgaccgggaugcggaacauccccgagaaacagacacgcggaaucuucggcgccauugcuggguuuaucgaaaauggaugggagggcaugguggaugggugguauggauucagacaccagaacuccgagggccggggccaagccgcugaccucaagagcacccaggccgccauugaucagaucaaugggaaacugaacagacugauuggaaagacaaaugaaaaauuccaccagaucgagaaggaauuuucugaggucgaaggccgcauucaagaccuugagaaguacguugaggauaccaaaaucgaccugugguccuauaacgcugaacuccugguggcgcuggagaaccagcauacgaucgaucucacagacagcgaaaugaauaagcuguucgagaaaaccaagaaacagcuucgggaaaacgccgaggauauggggaauggaugcuuuaagauuuaccacaagugugacaacgcuugcaucggcucuauuagaaaugggaccuauaaccauaauguguaccgcgaugaggcccugaacaaucgguuccagaucaaaggcgucgaacucaaguccggauacaaagacuggauucuguggaucagcuuugccaucuccugcuuccuucuguguguggcucuccugggcuuuauuaugugggccugccaaaaggggaacaucagauguaauauuugcaucuga

SEQ ID NO: 192581 - RNA, 1701 nt, Artificial Sequence
  derived and/or modified sequence opt5 from hemagglutinin__InfluenzaA__AFN19688
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcgacucuccgcaccagauccuugauggggagaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugagucuuucaacuggaccggagugacacagaauggcaccuccagcgcuugcauccgcagaucuaacuccagcuuuuucucucggcugaauuggcucacacaucugaacuuuaaauauccugcccuuaaugucaccaugcccaacaacgaacaguucgacaagcuguacauuuggggcgugcaccauccugggacggauaaggaccagaucuuucucuaugcgcaauccagcggacgcauuacaguuuccaccaaaagaucucagcaggccgugaucccgaauauuggcagccggccccgcaucagaaacaucccuucccggauuagcaucuacuggacaauugucaagcccggggauauccugcugauuaauucuaccggaaaccucaucgcuccucgcggcuacuucaaaaucagauccggaaagagcucuauuaugcggagcgacgcccccaucgggaaauguaauuccgagugcauuaccccgaacggcucuaucccuaaugacaagcccuuucagaacgugaaucgcauuacauauggcgcuuguccuagauacgugaagcaaagcacgcugaaacuugccaccgggaugcggaacguccccgaaaagcagacacgcggaaucuucggcgcgaucgccggguuuauugagaauggaugggagggcaugguugaugggugguauggauucagacaccagaacuccgaaggccggggccaagcugccgaccugaaaagcacccaggcugccaucgaucagauuaaugggaagcucaacagacugaucggaaaaacaaaugagaaguuccaccagauugaaaaagaguuuucugaaguggagggccgcauccaagaccuugagaaguacguggaagauaccaagauugaccugugguccuauaacgccgagcuccuggucgcucuggaaaaccagcauacgaucgaucucacagacagcgagaugaauaaacuguucgaaaagaccaaaaagcagcuucgggagaacgcggaggauauggggaauggaugcuuuaaaaucuaccacaagugugacaacgccugcauuggcucuaucagaaaugggaccuauaaccaugauguguaccgcgacgaagcucugaauaaccgguuccagauuaagggcguugagcucaaauccggauacaaggacuggauccuguggauuagcuuugccaucuccugcuuccuucuguguguggcccuccugggcuuuaucaugugggcuugccaaaaagggaauauuagauguaacaucugcauuuga

SEQ ID NO: 192582 - RNA, 1701 nt, Artificial Sequence
  derived and/or modified sequence opt5 from hemagglutinin__InfluenzaA__AFN19690
augaagaccacaaucgcccugagcuacauucucugccugguguucgcucagaaacuucccggcaacgacaauuccacggccacccugugucucgggcaccaugcggucccuaacggaacaaucguuaagaccauuacaaaugauagaaucgaggugaccaacgcuacagaacuggugcaaaauucuagcauuggcgagaucugcgacuccccgcaccagauccuugauggggaaaacuguacccugauugacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacgcuugaauuuaauaacgagagcuucaauuggaccggagugacacaaaacggcaccucuuccgcuugcaucagacggagcaauaacuccuuuuucucucgccugaauuggcucacacaucugaacuuuaaguauccugcccuuaacgucaccaugcccaauaacgagcaguucgacaagcuguacauuuggggcgugcaccauccugggacggauaaagaccagaucuuucucuaugcgcagagcucuggaagaauuacaguuuccaccaagcggagccaacaggccgugaucccgaauauuggcucccgccccagaauccggaacaucccuucucgcauuagcaucuacuggacaauugucaaacccggggauauccugcugauuaauuccaccggaaaccucaucgcuccuagaggcuacuucaagauccggagcgggaaaucuuccauuaugcgcagcgacgcccccaucggaaaguguaagucugaaugcauuaccccgaauggcagcaucccuaacgacaaacccuuucagaaugugaacagaauuacauauggcgcuuguccucgguacgugaagcaguccacgcugaaacuugccaccgggaugcgcaauguccccgagaagcaaacaagaggaaucuucggcgcgaucgccggguuuauugaaaacggaugggagggcaugguugaugggugguauggauuccggcaccaaaauucugagggcagaggccaggcugccgaccugaaaagcacccaggcugccaucgaucagauuaacgggaagcucaaucgccugaucggaaaaacaaacgaaaaguuccaccagauugagaaggaauuuuccgagguggaaggccggauccaggaccuugagaaauacguggaggauaccaagauugaccuguggagcuauaacgccgaacuccuggucgcucuggagaaucaacauacgaucgaucucacagacucugaaaugaacaaacuguucgagaagaccaaaaagcagcuuagagaaaaugcggaggauauggggaacggaugcuuuaagaucuaccacaaaugugacaaugccugcauuggcuccauccgcaacgggaccuaugaucaugacguguaccgggacgaggcucugaauaacagauuccagauuaagggcguugaucucaaaagcggauacaaggacuggauccuguggauuucuuuugccaucuccugcuuccuucuguguguggcccuccugggcuuuaucaugugggcuugccagaaagggaauauucgcuguaacaucugcauuuga

SEQ ID NO: 192583 - RNA, 1701 nt, Artificial Sequence
  derived and/or modified sequence opt5 from hemagglutinin__InfluenzaA__AFN19692
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauucgcagaucugacuccagcuuuuucucucggcuuaacuggcugacacaucucaauuuuaaguauccugcccugaacgucaccaugcccaauaacgagcaguucgauaagcuguacaucuggggcgugcaccauccugggacggacaaagaucagauuuuucuguaugcgcaagccuccggacgcaucacaguuagcaccaagagaucccagcaggcugugauuccgaacaucggcucucggccccgcaucagaaauauuccuagccggaucuccauuuacuggacaaucgucaaacccggggacauucuccugaucaacagcaccggaaaucugaucgccccucgcggcuacuucaagauuagaucugggaaauccagcaucaugcggucugacgcucccauuggaaaguguaacagcgaaugcaucaccccgaauggcuccauuccuaacgauaagcccuuucagaaugugaaccgcaucacauauggcgccuguccuagauacgugaaacaaaauacgcucaagcuggcgaccgggaugcggaacguccccgagaaacagacacgcggaaucuucggcgccauugcuggguuuaucgaaaauggaugggagggcaugguugacgggugguauggauucagacaccagaacucugagggccggggccaagccgcugaucuuaagagcacccaggccgccauugaccagaucaaugggaaacugaacagacucauuggaaagacaaaugaaaaauuccaccagaucgagaaggaauuuuccgagguggaaggccgcauucaagaucuggagaaguacguggaggacaccaaaaucgaucuuuggagcuauaacgcugaacugcucgucgcgcuggagaaccagcauacgaucgaccugacagauucugaaaugaauaaacucuucgagaagaccaagaaacagcugcgggaaaacgccgaggacauggggaauggaugcuuuaagauuuaccacaagugugauaacgcuugcaucggcuccauuagaaaugggaccuauaaccaugacguguaccgcgacgaggcccuuaauaaccgguuccagaucaaaggcguugaacuuaagagcggauacaaagauuggauucucuggaucucuuuugccaucuccugcuuccugcuuuguguggcucugcucggcuuuauuaugugggccugccaaaaggggaauaucagauguaacauuugcaucuga

SEQ ID NO: 192584 - RNA, 1701 nt, Artificial Sequence
  derived and/or modified sequence opt5 from hemagglutinin__InfluenzaA__AFN19694
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuccgaucggcgagaucugcgacagcccccaccagauucuugauggggaaaacuguacacugaucgacgcccuccugggagauccucagugcgacggcuuucagaauaaaaagugggaucuguucgucgagcgguccaaagccuauucuaacuguuaccccuaugacgugccugauuacgcuagccuccgcucccugguugccucuagcgggacccuugaauuuaauaacgaguccuucaauuggacgggagugacccaaaacggcacaagcucugcuugcauuagacgguccaauaacagcuuuuucucucgccugaauuggcucacccaucugaacuuuaaguaucccgcccuuaacgucacaaugccuaauaacgagcaguucgacaagcuguacaucuggggcgugcaccauccggggaccgauaaagaccagauuuuucucuaugcgcaguccagcggaagaaucacgguuucuacaaagcggucccaacaggccgugauucccaauaucggcagccgcccuagaauccggaacauucccucccgcaucucuauuuacuggaccaucgucaaaccuggggauauucugcugaucaauagcacaggaaaccucaucgcucccagaggcuacuucaagauucgguccgggaaaagcucuaucaugcgcuccgacgccccgauuggaaaguguaagagcgaaugcaucaccccuaauggcucuauucccaacgacaaaccuuuucagaaugugaacagaaucaccuauggcgcuuguccccgguacgugaagcagagcacacugaaacuugccacggggaugcgcaauguccccgagaagcaaaccagaggaaucuucggcgcgauugccggguuuaucgaaaacggaugggagggcaugguugaugggugguauggauuccggcaccaaaauuccgagggcagaggccaggcugccgaccugaaaucuacacaggcugccauugaucagaucaacgggaagcucaaucgccugauuggaaaaaccaacgaaaaguuccaccagaucgagaaggaauuuagcgagguggaaggccggauucaggaccuugagaaauacguggaggauacaaagaucgaccugugguccuauaacgccgaacuccuggucgcucuggagaaucaacauaccaucgaucucacggacagcgaaaugaacaaacuguucgagaagaccaaaaagcagcuuagagaaaaugcggaggauauggggaacggaugcuuuaagauuuaccacaaaugugacaaugccugcaucggcucuauucgcaacgggacauaugaucaugacguguaccgggacgaggcucugaauaacagauuccagaucaagggcguugaacucaaauccggauacaaggauuggauucuguggaucagcuuugccaucucuugcuuccuucuguguguggcccuccugggcuuuauuaugugggcuugccagaaagggaauauccgcuguaacauuugcaucuga

SEQ ID NO: 192585 - RNA, 1701 nt, Artificial Sequence
  derived and/or modified sequence opt5 from hemagglutinin__InfluenzaA__AFN19700
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagcgcuucaauuggagcggagugacgcagaacggcaccucuuccgcuugcaugagacggagcaauucuuccuuuuucagccgccugaacuggcucacacaucugaauuuuaaguauccugcccuuaacgucaccaugcccaacaaugagcaguucgacaagcuguacauuuggggcgugcaccauccugggacagauaaagaccagaucuuucucuaugcgcaaucuuccggaagaauuaccguuagcacgaagcggucccagcaggccgugaucccgaacauuggcucucgccccagaauccggaauaucccuagccgcauuuccaucuacuggacaauugucaaacccggggauauccugcugauuaacagcaccggaaaucucaucgcuccuagaggcuacuucaagauccggucugggaaauccagcauuaugcgcucugacgcccccaucggaaaguguaacagcgaaugcauuacaccgaauggcuccaucccuaacgacaagcccuuucagaaugugaacagaauuaccuauggcgcuuguccucgguacgugaaacaaucuacccugaaacuugccacagggaugcgcaauguccccgagaagcagacgagaggaaucuucggcgcgaucgccggguuuauugaaaacggaugggagggcaugguugaugggugguauggauuccggcaccagaauagcgagggcagaggccaagcugccgaccugaaguccacccaggcugccaucgaucagauuaacgggaaacucaaucgccugaucggaaagacaaacgaaaaauuccaccagauugagaaggaauuuagcgagguggaaggccggauccaagaccuugagaaguacguggaggauaccaaaauugaccuguggucuuauaacgccgaacuccuggucgcucuggagaaucagcauacaaucgaucucaccgacuccgaaaugaacaagcuguucgagaaaacgaagaaacagcuuagagaaaaugcggaggauauggggaacggaugcuuuaagaucuaccacaagugugacaaugccugcauuggcagcauccgcaacgggacauaugaucaugacguguaccgggacgaggcucugaauaacagauuccagauuaaaggcguugaacucaagucuggauacaaagauuggauccuguggauuuccuuugccaucagcugcuuccuucuguguguggcccuccugggcuuuaucaugugggcuugccaaaaggggaauauucgcuguaacaucugcauuuga

SEQ ID NO: 192586 - RNA, 1701 nt, Artificial Sequence
  derived and/or modified sequence opt5 from hemagglutinin__InfluenzaA__AFN19702
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcgggggaaagccuauucuaacuguuacccuuaugacgugcccgauuacgcuagccuccgcucccugguugccucuagcggaacccuugaauuuaauaacgaguccuucaauuggacgggcgugacccaaaacggcacaagcucugcuugcauuagacgguccaauaacagcuuuuucucucgccugaauuggcucacccaucugaacuuuaaguauccugcccuuaacgucacaaugcccaauaacgagcaguucgacaagcuguacaucuggggagugcaccauccugggaccgauaaagaccagauuuuucucuaugcgcaguccagcggcagaaucacgguuucuacaaagcggucccaacaggccgugauuccgaauaucgggagccgccccagaauccggaacauuccuucccgcaucucuauuuacuggaccaucgucaaacccggagauauucugcugaucaauagcacaggcaaccucaucgcuccuagaggguacuucaagauucgguccggaaaaagcucuaucaugcgcuccgacgcccccauuggcaaguguaagagcgaaugcaucaccccgaauggcucuauuccuaacgacaaacccuuucagaaugugaacagaaucaccuauggggcuuguccucgguacgugaagcagagcacacugaaacuugccacgggaaugcgcaauguccccgagaagcaaaccagaggcaucuucggggcgauugccggauuuaucgaaaacggcugggaggggaugguugauggaugguauggcuuccggcaccaaaauuccgagggcagagggcaggcugccgaccugaaaucuacacaggcugccauugaucagaucaacggaaagcucaaucgccugauuggcaaaaccaacgaaaaguuccaccagaucgagaaggaauuuagcgagguggaagggcggauucaggaccuugagaaauacguggaggauacaaagaucgaccugugguccuauaacgccgaacuccuggucgcucuggagaaucaacauaccaucgaucucacggacagcgaaaugaacaaacuguucgagaagaccaaaaagcagcuuagagaaaaugcggaggauaugggaaacggcugcuuuaagauuuaccacaaaugugacaaugccugcaucgggucuauucgcaacggcacauaugaucaugacguguaccgggacgaggcucugaauaacagauuccagaucaagggaguugaacucaaauccggcuacaaggauuggauucuguggaucagcuuugccaucucuugcuuccuucuguguguggcccuccugggguuuauuaugugggcuugccagaaaggaaauauccgcuguaacauuugcaucuga

SEQ ID NO: 192587 - RNA, 1701 nt, Artificial Sequence; identical to SEQ ID NO: 189839
  derived and/or modified sequence opt5 from hemagglutinin__InfluenzaA__AFN19709

SEQ ID NO: 192588 - RNA, 1701 nt, Artificial Sequence
  derived and/or modified sequence opt5 from hemagglutinin__InfluenzaA__AFN19719
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcacacagcucaagaacaaugccaaggagauugggaacggauguuuugaguucuaucacaaaugcgacaauacguguauggaaagcgugaagaacggcaccuacgauuauccuaaauacucugaagaggccaagcugaauagagaagagaucgacgggguuaaacuugaguccacacggguguaucaaauccuggcuauuuacagcaccgucgccucuucccucgugcugguugugagccugggcgcgaucuccuuuuggaugugcucuaacggaagccuccagugccgcauuuguaucuga

SEQ ID NO: 192589 - RNA, 1701 nt, Artificial Sequence; identical to SEQ ID NO: 189459
  derived and/or modified sequence opt5 from hemagglutinin__InfluenzaA__AFN19730

SEQ ID NO: 192590 - RNA, 1701 nt, Artificial Sequence; identical to SEQ ID NO: 189839
  derived and/or modified sequence opt5 from hemagglutinin__InfluenzaA__AFN19736

SEQ ID NO: 192591 - RNA, 1701 nt, Artificial Sequence
  derived and/or modified sequence opt5 from hemagglutinin__InfluenzaA__AFN19748
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaccggcaacagcuacccuaagcuguccaaaagcuauauuaaugacaaggggaaggaagugcuuguccuguggggaauccaccaccccuccacaaccgccgaucaacagucucucuaccagaacgcugacacguacguguucgugggcacaagcagauauuccaaaaaguuuaaaccugagauugccauccggccgaagguccgcgaucaggaggggagaaugaauuacuauuggacccugguugaacccggagacaaaauuacauucgaggcuaccggcaaccugguggugccucgguacgccuuugcgauggaacgcaacgccgggagcggaaucauuaucucugauacccccguccaugacugcaauacaacgugucaaaccccuaagggcgcuaucaacacaucccuccccuuccagaauauucacccgaucaccauuggcaaaugcccuaaguauguuaagagcacaaaacugagacuugccaccgggcugcggaacgugcccucuauccagagccgcggacucuuuggcgcuauugccggguucaucgagggaggcuggacggggaugguggacggaugguacggcuaucaucaccagaaugaacaaggcuccggguacgccgcugaucugaagucuacacagaacgcgaucgacaaaauuaccaauaaggucaacagcgugaucgagaaaaugaauacccaguuuacagccguuggaaaggaguucaaccaccuugaaaagagaauugagaaucugaacaaaaagguggaugacggcuuccucgauaucuggaccuacaaugcugaacugcugguccuccuggagaacgaacggacacuugacuaucaugauuccaaugugaaaaaccuguacgagaagguccgcaaccagcucaaaaauaacgccaaggagacggggaauggauguuuugaguucuaucacaagugcgacaacaccuguauggagagcgugaaaaauggcacauacgauuauccuaaguacucugaagaggccaaacugaacagagaagagauugacgggguuaaacuugaguccacccggaucuaucaaauccuggcuauuuacagcacaguggccucuucccucguccuggugguuagccugggcgcgaucuccuuuuggaugugcucuaauggaagccuccagugccgcauuuguaucuga

SEQ ID NO: 192592 - RNA, 1701 nt, Artificial Sequence; identical to SEQ ID NO: 189848
  derived and/or modified sequence opt5 from hemagglutinin__InfluenzaA__AFN19757

SEQ ID NO: 192593 - RNA, 1701 nt, Artificial Sequence; identical to SEQ ID NO: 189839
  derived and/or modified sequence opt5 from hemagglutinin__InfluenzaA__AFN19768

SEQ ID NO: 192594 - RNA, 1701 nt, Artificial Sequence
  derived and/or modified sequence opt5 from hemagglutinin__InfluenzaA__AFN19781
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcggucgaacgcaacgccgggagcggaaucauuaucucugauacccccgugcaugacugcaauaccacaugucaaacgccuaaaggcgcuaucaacaccucccuccccuuccagaauauucacccgaucacaauuggcaagugcccuaaguauguuaaaagcaccaagcugagacuugccacagggcugcggaacgugcccucuauccagagccgcggacucuuuggcgcuauugccggguucaucgagggaggcuggaccgggauggucgacggaugguacggcuaucaucaccagaaugaacaaggcuccggguacgccgcugaucugaaaucuacgcagaacgcgaucgacaagauuacaaauaaagugaacagcguuaucgagaagaugaauacccaguuuaccgccgugggaaaggaguucaaccaccuugagaaaagaauugagaaucugaacaagaaagucgaugacggcuuccucgauaucuggacauacaaugcugaacugcuggugcuccuggagaacgaacggacccuugacuaucaugauuccaaugucaagaaccuguacgagaaagugcgcaaccagcucaagaauaacgccaaggagauugggaauggauguuuugaguucuaucacaaaugcgacaacacauguauggaaagcguuaagaauggcacguacgauuauccuaaauacucugaagaggccaagcugaacagagaagagaucgacggggugaaacuugaguccacccggaucuaucaaauucuggcuaucuacagcacagucgccucuucccucgugcugguugugagccugggcgcgauuuccuuuuggaugugcucuaauggaagccuccagugccgcaucuguauuuga

SEQ ID NO: 192595 - RNA, 1701 nt, Artificial Sequence
  derived and/or modified sequence opt5 from hemagglutinin__InfluenzaA__AFN19791
augaaggccauccuggugguccuccuguacaccuucgcuauugccaacgcggacacacuuugcaucggcuaucacgcuaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacauccucuagcgacaacggaaccugcuauccgggggauuuuaucaauuacgaagaacugcgggagcagcuuuccagcgucucuuccuucgaacgcuuugagaucuuccccaagacgagcucuuggccuaaccacgacuccaauaagggagugaccgccgcuuguccccaugccggcgcgaaaucuuuuuauaagaaccugauuuggcucguuaaaaagggcaauagcuacccuaaacuguccaagagcuauaucaacgauaaggggaaagaagugcuuguccuguggggcauucaccaccccuccacaucugccgaccaacagagccucuaccagaaugcugaugccuacguguucgugggcaccuccaaguauagcaaaaaguuuaaaccugagaucgcugucagaccgaagguucgggaccaggaggggcgcaugaacuacuauuggacacugguggaacccggagauaaaauuaccuucgaggccacgggcaaccugcucgugccuagauacgcguuugccauggaacggaaugcugggucuggaaucauuaucuccgacacacccguccaugauugcaacaccacaugucaaaccccugagggcgccaucaauaccagccugcccuuccagaacauucacccgaucacaauuggcaagugcccuaaguaugugaaaucuacgaaacuucgccuggcuaccgggcucagaaauguucccagcauccagucccggggacuguuuggcgccauugccggguucaucgaaggaggcuggacagggaugguggacggaugguacggcuaucaucaccagaacgagcaaggcucuggguacgcugcggaccuuaagagcacccagaaugccaucgauaagauuacaaacaaagucaauuccgugaucgagaagaugaacacccaguuuacggcuguuggaaaggaguucaaucaccuggagaaacgcauugaaaaccucaauaagaaaguggacgauggcuuccuggacaucuggacauacaacgccgagcugcucguccugcuugaaaaugagagaacccuggauuaucaugacagcaacgugaagaaccucuacgagaaaguccggucucagcugaagaauaacgccaaggaaauugggaauggauguuuugaguucuaucacaaaugcgauaacaccuguauggaauccgugaagaauggcacauacgacuauccuaaauacagcgaggaagcuaaacuuaaccgcgaggagaucgaugggguuaagcuggaaucuaccagaaucuaucaaauucucgccaucuacuccacaguggcgagcucccugguccugauugugucucucggcgcuaucagcuuuuggaugugcuccaauggaucucugcagugccggauuuguaucuga

SEQ ID NO: 192596 - RNA, 1701 nt, Artificial Sequence; identical to SEQ ID NO: 189839
  derived and/or modified sequence opt5 from hemagglutinin__InfluenzaA__AFN19806

SEQ ID NO: 192597 - RNA, 1701 nt, Artificial Sequence
  derived and/or modified sequence opt5 from hemagglutinin__InfluenzaA__AFN19808
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaacuccuggucuuacaucguggagaccagcuccucugacaauggcacgugcuauccgggggauuuuauugacuacgaagaacugcgggagcagcuuagcuccgucagcucuuucgaacgcuuugagaucuuccccaagaccaacuccuggccuaaucacgauagcaacaagggagugacagccgcuuguccccaugccggcgcgaaaucuuuuuauaagaaucugaucuggcucguuaaaaagggcaacuccuacccuaaacugagcaagucuuauauuaaugacaaggggaaagaagugcuuguccuguggggaauccaccaccccuccaccagcgccgaucaacagucccucuaccagaacgcugacgccuacguguucgugggcacaucuagauauagcaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccgcccaugacugcaauacaaccugucaaaccccuaaaggcgcuaucaacacaucucuccccuuccagaauauucacccgaucacgauuggcaagugcccuaaguaugucaacuccaccaaacugagacuugccacagggcugcggaaugugcccagcauccagucucgcggacucuuuggcgccauugcuggguucaucgagggaggcuggaccgggaugguugacggaugguacggcuaucaucaccagaacgaacaaggcagcggguacgcggccgaucugaaguccacacagaaugcuaucgacaaaauuaccaacaaggucaauucugugaucgagaaaaugaacacgcaguuuacagccgugggaaaggaguucaaucaccuugaaaagagaauugagaaccugaauaaaaagguugaugacggcuuccucgauaucuggaccuacaacgccgaacugcuggugcuccuggagaacgaacggacccuugacuaucaugauagcaaugucaaaaaccuguacgagaaggugcgcucccagcucaaaaauaacgcuaaggagauugggaauggauguuuugaguucuaucacaagugcgacaacacauguauggagagcgucaaaaauggcaccuacgauuauccuaaguacucugaagaggccaaacugaacagagaagagaucgacggggugaaacuugaguccacacggaucuaucaaauucuggcgaucuacagcacgguugcuucuucccucgugcuggucgugagccugggcgccauuuccuuuuggaugugcucuaauggaagccuccagugccgcaucuguauuuga

SEQ ID NO: 192598 - RNA, 1701 nt, Artificial Sequence; identical to SEQ ID NO: 189848
  derived and/or modified sequence opt5 from hemagglutinin__InfluenzaA__AFN19814

SEQ ID NO: 192599 - RNA, 1701 nt, Artificial Sequence
  derived and/or modified sequence opt5 from hemagglutinin__InfluenzaA__AFN19816
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcgaugccggauccggcaucauuaucagcgacacccccguccaugacugcaacaccacaugucaaacgccuaaaggcgcuaucaauaccucucuccccuuccagaacauucacccgaucacaauugggaagugcccuaaguaugugaaauccaccaagcugagacuugccacaggacugcggaauguucccagcauccagucucgcggccucuuuggggcuauugccggauucaucgagggcggguggaccggaaugguggauggcugguacggcuaucaucaccagaacgaacaagggagcggauacgccgcugaccugaaauccacgcagaaugcgaucgauaagauuacaaacaaagucaauucugugaucgagaagaugaacacccaguuuaccgccguuggcaaggaguucaaucaccuugagaaaagaauugagaaccugaauaagaaaguggacgauggguuccucgacaucuggacauacaacgcugaacugcugguccuccuggagaaugaacggacccuugauuaucaugacagcaacgugaagaaucuguacgagaaaguccgcaaccagcucaagaacaaugccaaggagauuggaaacggcuguuuugaguucuaucacaaaugcgauaauacauguauggaauccgugaagaacgggacguacgacuauccuaaauacagcgaagaggccaagcugaauagagaagagaucgauggcguuaaacuugagucuacccggaucuaucaaauucuggcuaucuacuccacaguggccagcucucucguccuggugguuucccugggagcgauuagcuuuuggaugugcuccaacggcucucuccagugccgcaucuguauuuga

SEQ ID NO: 192600 - RNA, 1701 nt, Artificial Sequence
  derived and/or modified sequence opt5 from hemagglutinin__InfluenzaA__AFN19821
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaacugaagccugagauugccauccggccgaaaguccgcgaucaggaggggagaaugaauuacuauuggacacugguugaacccggaggcaagauuaccuuugaggcuacagggaaccucguggugccucgguacgccuucgcgauggaacgcaacgccggaagcggcaucauuaucucugacacccccguccaugauugcaauaccacaugucaaacgccuaaaggcgcuaucaacaccucccugcccuuucagaauauucacccgaucacaauugggaagugcccuaaguaugugaaaagcaccaaacuuagacuggccacaggacuccggaacguucccucuauccagagccgcggccuguucggggcuauugccggauuuaucgagggcggguggaccggaaugguggacggcugguacggcuaucaucaccagaaugaacaaggguccggauacgccgcugaccuuaaaucuacgcagaacgcgaucgauaagauuacaaauaaagucaacagcgugaucgagaagaugaauacccaguucaccgccguuggcaaggaguuuaaccaccuggaaaagagaauugagaaucucaacaagaaaguggacgauggguuccuggacaucuggacauacaaugcugaacugcucguccugcuugagaacgaacggacccuggauuaucaugacuccaaugugaagaaccucuacgagaaaguccgcaaccagcugaagaauaacgccaaggagauuggaaauggcuguuucgaauuuuaucacaaaugcgauaacacauguauggagagcgugaagaaugggacguacgacuauccuaaauacucugaagaggccaaacuuaacagagaagagaucgauggcguuaagcuggaguccacccggaucuaucaaauucucgcuaucuacagcacaguggccucuucccugguccuggugguuagccucggagcgauuuccuucuggaugugcucuaauggcagccugcagugccgcaucuguauuuga

SEQ ID NO: 192601 - RNA, 1701 nt, Artificial Sequence; identical to SEQ ID NO: 189459
  derived and/or modified sequence opt5 from hemagglutinin__InfluenzaA__AFN19831

SEQ ID NO: 192602 - RNA, 1701 nt, Artificial Sequence
  derived and/or modified sequence opt5 from hemagglutinin__InfluenzaA__AFN19849
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcgacaucgccggguggauucugggaaacccugagugugaaucucucagcacagccuccucuuggagcuacaucguggagaccuccucuagcgauaauggcacgugcuauccgggggacuuuauuaacuacgaggaacugcgggagcagcuuuccagcgucucuuccuucgaacgcuuugagaucuuccccaagaccagcucuuggccuaaucacgauuccaacaagggagugacagccgcuuguccccaagccggcgcgaaaucuuuuuauaagaaucugaucuggcucguuaaaaagggcaacagcuacccuaaacuguccaagagcuauauuaaugacaaggggaaagaagugcuuguccuguggggaauccaucaccccuccaccucugccgaucagcagagccucuaccagaacgcugacgccuacguguucgugggcacauccaaguauagcaaaaaguuuaaaccugagauugcugucagaccgaagguucgggaucaagaggggcgcaugaauuacuauuggacccugguggaacccggagacaaaaucacguucgaggccacaggcaaccugcucgugccuagauacgcguuugccauggaacggaacgcugggucuggaauuaucauuuccgauacccccguccacgacugcaauacaaccugucagaccccuaagggcgccaucaacacaagccugcccuuccagaauauccauccgauuacgaucggcaagugcccuaaauaugugaagucuaccaaacuucgccuggcuacagggcucagaaacguucccagcauucagucccggggacuguuuggcgccaucgccggguucauugagggaggcuggaccgggaugguggacggaugguacggcuaucaccaucaaaaugcucagggcucuggguacgcggccgaucuuaagagcacacagaacgcuaucgacaaaaucaccaauaaggucaacuccgugauugaaaagaugaauacgcaguuuacagccguuggaaaagaguucaaccaccuggagaagcgcaucgaaaaucucaacaaaaagguggaugacggcuuccuggauauuuggaccuacaaugccgagcugcucguccugcuugaaaacgagagaacccuggacuaucacgauagcaaugugaaaaaccucuacgaaaagguccggucucaacugaagaacaaugcuaaagagaucggggacggauguuuugaguucuaucauaagugcgauaacacauguauggaauccgugaaaaauggcaccuacgacuauccuaaguacagcgaggaagccaaacuuaaccgcgaggaaauugaugggguuaagcuggagucuacaagaaucuaucagauccucgcgauuuacuccacgguggcuagcucccugguccuggugguuucucucggcgccaucagcuuuuggaugugcuccaauggaucucugcagugccggauuuguaucuga

SEQ ID NO: 192603 - RNA, 1701 nt, Artificial Sequence
  derived and/or modified sequence opt5 from hemagglutinin__InfluenzaA__AFN19865
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacgccuacguguucgugggcaccagcagauauuccaagaaauuuaagccugagauugcuauccggccgaaaguccgcgaucaggaggggagaaugaauuacuauuggacgcugguugaacccggagacaagauuacauucgaggccaccggcaaccugguggugccucgguacgcguuugccauggaacgcaacgcugggagcggaaucauuaucucugauacacucguccaugacugcaauaccaccugucaaacacccaaaggcgccaucaacacgucccugccuuuccagaauauucaccccaucaccauuggcaagugcccgaaguaugugaaaagcacaaaacuuagacuggcuaccgggcuccggaacguuccuucuauccagagccgcggacuguuuggcgccauugccggguucaucgagggaggcuggacagggaugguggacggaugguacggcuaucaucaccagaaugaacaaggcuccggguacgcugcggaucuuaaaucuacccagaacgccaucgacaagauuacgaauaaagucaacagcgugaucgagaagaugaauacacaguuuaccgcuguuggaaaggaguucaaccaccuggaaaagagaauugagaaucucaacaagaaaguggaugacggcuuccuggauaucuggaccuacaaugccgaacugcucguccugcuugagaacgaacggacacuggacuaucaugauuccaaugugaagaaccucuacgagaaaguccgcaaccagcugaagaauaacgccaaggagauugggaauggauguuuugaguucuaucacaaaugcgacaacaccuguauggagagcgugaagaauggcacauacgauuaucccaaauacucugaagaggcuaaacuuaacagagaagagaucgacgggguuaagcuggaguccacgcggaucuaucaaauucucgccaucuacagcaccguggcgucuucccugguccuggugguuagccucggcgcuauuuccuuuuggaugugcucuaauggaagccugcagugccgcaucuguauuuga

SEQ ID NO: 192604 - RNA, 1701 nt, Artificial Sequence
  derived and/or modified sequence opt5 from hemagglutinin__InfluenzaA__AFN19875
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgaaaagagcuuuuauaaaaaccugaucuggcucguuaaaaagggcaauucuuacccuaaacuguccaagagcuauauuaacgauaaggggaaagaggugcuuguccuguggggaauccaccaccccuccaccucugcggaccaacagagccucuaccagaaugccgaugcuuacguguucgugggcacauccaaguauagcaaaaaguuuaaaccugagauugccgucagaccgaagguucgggaccaggaagggcgcaugaacuacuauuggacccugguggagcccggagauaaaaucacguucgaagcuacaggcaaccugcucgugccuagauacgccuuugcgauggagcggaaugccgggucuggaauuaucauuuccgacacccccguccaugauugcaacacaaccugucaaaccccuaagggcgcuaucaauacaagccugcccuuccagaacauccacccgauuacgaucggcaagugcccuaaauaugugaagucuaccaaacuucgccuggccacagggcucagaaauguucccagcauucagucccggggacuguuuggcgcuaucgccggguucauugaaggaggcuggaccgggaugguggacggaugguacggcuaucaucaccagaacgagcaaggcucuggguacgccgcugaccuuaagagcacacagaaugcgaucgauaaaaucaccaacaaggucaauuccgugauugagaagaugaacacgcaguuuacagccguuggaaaagaguucaaucaccuggagaagcgcaucgaaaaccucaauaaaaagguggacgauggcuuccuggacauuuggaccuacaacgcugagcugcucguccugcuugaaaaugagagaacccuggauuaucaugacagcaacgugaaaaaccucuacgagaagguccggucucagcugaagaauaacgccaaagaaaucgggaauggauguuuugaguucuaucacaagugcgauaacacauguauggaauccgugaaaaauggcaccuacgacuauccuaaguacagcgaggaagccaaacuuaaccgcgaggagauugaugggguuaagcuggaaucuacaagaaucuaucaaauccucgcuauuuacuccacgguggccagcucccugguccuggugguuucucucggcgcgaucagcuuuuggaugugcuccaauggaucucugcagugccggauuuguaucuga

SEQ ID NO: 192605 - RNA, 1701 nt, Artificial Sequence
  derived and/or modified sequence opt5 from hemagglutinin__InfluenzaA__AFN19895
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaaauuuccaagagcuauaucaaugacaaggggaaagaagugcugguccuuuggggcauucaccaccccuccaccacagccgaucaacagucucuguaccagaacgcugacaccuacguguucgugggaacgagcagauauuccaagaaauuuaagccugagaucgccauucggccgaaaguccgcgaucaggaggggagaaugaauuacuauuggacacucguugaacccggagacaagaucaccuucgaggcuacaggcaaccugguggugccucgguacgccuuugcgauggaacgcaacgccgggagcggaauuaucaucucugauacccccguccaugacugcaauaccacaugucaaacgccuaaaggcgcuauuaacaccucccugcccuuccagaauauccacccgauuacaaucggcagaugcccuaaguauguuaagagcaccaaacuccggcuggccacagggcuucgcaacgugcccucuauucagagcagaggacuguuuggcgcuaucgccggguucaucgagggaggcuggaccgggaugguggacggaugguacggcuaucaucaccagaaugaacaaggcuccggguacgccgcugaucucaagucuacgcagaacgcgauugacaaaaucacaaauaaggucaacagcgugauugagaaaaugaauacccaguuuaccgccguuggaaaggaguucaaccaccuggaaaagcggaucgagaaucuuaacaaaaagguggaugacggcuuccuggauauuuggacauacaaugcugaacuccugguccugcucgagaacgaacgcacccuggacuaucaugauuccaaugugaaaaaccuuuacgagaaggucagaaaccagcugaaaaauaacgccaaggagacagggaauggauguuuugaguucuaucacaagugcgacaacacguguauggagagcgugaaaaauggcaccuacgauuauccuaaguacucugaagaggccaaacucaaccgggaaguuaucgacggggugaagcuggaguccacacgcaucuaucaaauucuugcuaucuacagcaccgucgccucuucccuggugcucguugugagccugggcgcgauuuccuuuuggaugugcucuaauggaagccugcagugcagaaucuguauuuga

SEQ ID NO: 192606 - RNA, 1701 nt, Artificial Sequence
  derived and/or modified sequence opt5 from hemagglutinin__InfluenzaA__AFN19905
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcggucgacaagaucacaaauaaagugaacucuguuauugagaagaugaauacccaguuuaccgccgugggcaaggaguucaaccaccuugaaaagagaaucgagaaucugaacaagaaagucgaugacggguuccucgauauuuggacauacaaugcugaacugcuggugcuccuggagaacgaacggacccuugacuaucaugauagcaaugucaagaaccuguacgagaaagugcgcaaccagcucaagaauaacgccaaggagaucggaaauggcuguuuugaguucuaucacaaaugcgacaacacauguauggaguccguuaagaaugggacguacgauuauccuaaauacagcgaagaggccaagcugaacagagagaaaauugacggcgugaaacuugaaucuacccggaucuaucaaauccuggcuauuuacuccacagucgccagcucucucgugcugaucguuucccugggagcgauuagcuuuuggaugugcuccaauggcucucuccagugccgcaucuguauuuga

SEQ ID NO: 192607 - RNA, 1701 nt, Artificial Sequence
  derived and/or modified sequence opt5 from hemagglutinin__InfluenzaA__AFN19915
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccagcuccuauauuaacgauaaggggaaggaagugcuuguccuguggggaauccaucaccccucuaccagcgccgaccagcagucccucuaccagaaugcugaugccuacguguucgugggcacaagcgaguauucuaaaaaguuuaaaccugagauugcugucagaccgaagguucgggaccaagaagggcgcaugaacuacuauuggacccugguggagcccggagauaaaaucacguucgaagccacaggcaaccugcucgugccuagauacgcguuugccauggagcggaaugcuggguccggaauuaucauuagcgacacccccguccacgauugcaacacaaccugucagaccccuaagggcgccaucaauacaucucugcccuuccagaacauccauccgauuacgaucggcaaaugcccuaaguauguuaagagcaccaaacuucgccuggcuacagggcucagaaaugugcccuccauucagucucggggacuguuuggcgccaucgccggguucauugaaggaggcuggaccgggaugguggacggaugguacggcuaucaccaucaaaacgcucagggcagcggguacgcggccgaccuuaaguccacacagaaugcuaucgauaaaaucaccaacaaggucaauagcgugauugagaaaaugaacacgcaguuuacagccguuggaaaggaguucaaucaccuggaaaagcgcaucgagaaccucaauaaaaagguggacgauggcuuccuggacauuuggaccuacaacgccgaacugcucguccugcuugagaaugaaagaacccuggauuaucacgacucuaacgugaaaaaccucuacgagaagguccggucccaacugaaaaauaacgcuaaggagaucgggaauggauguuuugaguucuaucauaagugcgauaacacauguauggagagcgugaaaaauggcaccuacgacuauccuaaguacucugaagaggccaaacuuaaccgcgaagagauugaugggguuaagcuggaguccacaagaaucuaucagauccucgcgauuuacagcacgguggcuuccucucugguccuggugguuagccucggcgccaucuccuuuuggaugugcucuaauggaagccugcagugccggauuuguaucuga

SEQ ID NO: 192608 - RNA, 1701 nt, Artificial Sequence
  derived and/or modified sequence opt5 from hemagglutinin__InfluenzaA__AFN19922
augaaggccauccugguggucguucucuacaccuucgcuacagccaacgcggacacgcugugcauuggcuaucacgcuaauaacagcaccgauacaguggacaccgugcuugagaaaaaugucacagugacccauuccguuaaccugcucgaagauaagcacaaugggaaacuguguaaacuuagaggaguggcuccccugcaucucggcaagugcaacaucgccggguggauucugggaaauccugagugugaaucucugagcacagccuccucuuggagcuacaucgucgagaccuccucuagcgacaacggcacgugcuauccgggggauuuuauugacuacgaagaacuccgggagcagcuguccagcgugucuuccuucgaacgcuuugagaucuuccccaagaccagcucuuggccuaaucacgauuccaacaagggaguuacagccgcuuguccccaugccggcgcgaaaggcuuuuauaagaaucuuaucuggcuggugaaaaaggggaacagcuacccuaaacucucuagauccuauauuaaugacaagggaaaggaaguccuggugcuuuggggcauccaccaccccagcaccacagccgaucaacagucccuguaccagaacgcugacaccuacguguucgucgggacgucucgguauagcaaaaaguuuaaaccugagauugccauccgcccgaagguuagagaucaggagggacggaugaauuacuauuggacacucguggaacccggcgacaaaauuaccuucgaggcuacagggaaccugguggucccucgcuacgccuuugcgauggaaagaaacgccggauccggcaucauuaucagcgauacccccgcucaagacugcaauaccacaugucagacgccuaagggcgccaucaacaccucucugcccuuccagaauauucauccgaucacaauugggaaaugcccuaaguaugugaaguccaccaaacuccggcuggcuacaggacuucgcaacguucccagcauccagucuagaggccuguuuggggccauugccggauucaucgagggcggguggaccggaaugguggacggcugguacggcuaucaccaucaaaaugaacaggggagcggauacgcugcggaucucaaguccacgcagaacgccaucgacaaaauuacaaauaaggucaacucugugaucgagaaaaugaauacccaguuuaccgcuguuggcaaggaguucaaccaccuggaaaagcggauugagaaucuuaacaaaaagguggaugacggguuccuggauaucuggacauacaaugccgaacuccugguccugcucgagaacgaacgcacccuggacuaucacgauagcaaugugaaaaaccuuuacgagaaggucagaaaccaacugaaaaauaacgccaaggagauuggaaauggcuguuuugaguucuaucauaagugcgacaacacauguauggaguccgugaaaaaugggacguacgauuauccuaaguacagcgaagaggcuaaacucaaccgggaagagaucgacggcguuaagcuggagucuacccgcaucuaucagauucuugccaucuacuccacaguggcgagcucucugguccucgugguuucccugggagcuauuagcuuuuggaugugcuccaauggcucucugcagugcagaaucuguauuuga

SEQ ID NO: 192609 - RNA, 1701 nt, Artificial Sequence; identical to SEQ ID NO: 189478
  derived and/or modified sequence opt5 from hemagglutinin__InfluenzaA__AFN19931

SEQ ID NO: 192610 - RNA, 1701 nt, Artificial Sequence
  derived and/or modified sequence opt5 from hemagglutinin__InfluenzaA__AFN19941
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucaauuacgaggaacugcgggagcagcuuagcuccgucagcucuuucgaacgcuuugagaucuuccccaagaccuccagcuggccuaaccacgacucuaauaagggagugacagccgcuuguccccaagccggcgcgaaauccuuuuauaagaaccugauuuggcucguuaaaaagggcaauagcuacccuaaacugucuaaguccuauaucaacgauaaggggaaagaagugcuuguccuguggggcauucaucaccccagcaccuccgccgaccagcagucucucuaccagaaugcugaugccuacguguucgugggaacaagcaaguauuccaaaaaguuuaaaccugagaucgcugucagaccgaagguucgggaccaagaggggcgcaugaacuacuauuggacccugguggaacccggagauaaaauuacguucgaggccacaggcaaccugcucgugccuagauacgcguuugccauggaacggaaugcugggagcggaaucauuaucucugacacccccguccacgauugcaacacaaccugucagaccccuaagggcgccaucaauacaucccugcccuuccagaacauucauccgaucacgauuggcaagugcccuaaauauguuaagagcaccaaacuucgccuggcuacagggcucagaaaugugcccucuauccagagccggggacuguuuggcgccauugccggguucaucgagggaggcuggaccgggaugguggacggaugguacggcuaucaccaucaaaacgcucagggcuccggguacgcggccgaccuuaagucuacacagaaugcuaucgauaaaauuaccaacaaggucaauagcgugaucgaaaagaugaacacgcaguuuacagccguuggaaaagaguucaaucaccuggagaagcgcauugaaaaccucaauaaaaagguggacgauggcuuccuggacaucuggaccuacaacgccgagcugcucguccugcuugaaaaugagagaacccuggauuaucacgacuccaacgugaaaaaccucuacgaaaagguccggagccaacugaagaauaacgcuaaagagauugggaauggauguuuugaguucuaucauaagugcgauaacacauguauggaaucugugaaaaauggcaccuacgacuauccuaaguacuccgaggaagccaaacuuaaccgcgaggaaaucgaugggguuaagcuggagagcacaagaaucuaucagauucucgcgaucuacucuacgguggcuuccagccugguccuggugguuucccucggcgccauuucuuuuuggaugugcagcaauggaucccugcagugccggaucuguauuuga

SEQ ID NO: 192611 - RNA, 1701 nt, Artificial Sequence
  derived and/or modified sequence opt5 from hemagglutinin__InfluenzaA__AFN19951
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaacccggagacaagauuaccuucgaggcuacaggcaaccugguggugccucgguacgccuuugcgauggaacgcaacgccgggagcggaaucauuaucucugauacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgagggaggcuggaccgggaugguggacggaugguacggcuaucaucaccagaaugaacaaggcuccggguacgccgcugaucugaaaucuacgcagaacgcgaucgacaagauuacaaauaaagucaacagcgugaucgagaagaugaauacccaguuuaccgccguuggaaaggaguucaaccaccuugagaaaagaauugagaaucugaacaagaaaguggaugacggcuuccucgauaucuggacauacaaugcugaacugcugguccuccuggagaacgaacggacccuugacuaucaugauuccaaugugaagaaccuguacgagaaaguccgcaaccagcucaagaauaacgccaaggagacagggaauggauguuuugaguucuaucacaaaugcgacaacacguguauggaaagcgugaagaauggcaccuacgauuauccuaaauacucugaagaggccaagcugaacagagaagagauugacgggguuaaacuugaguccacacggaucuaucaaauccuggcuauuuacagcaccgccgcgucuucccucgugcuggucgugagccugggcgcuaucuccuuuuggaugugcucuaauggaagccuccagugccgcauuuguaucuga

SEQ ID NO: 192612 - RNA, 1701 nt, Artificial Sequence; identical to SEQ ID NO: 189839
  derived and/or modified sequence opt5 from hemagglutinin__InfluenzaA__AFN19966

SEQ ID NO: 192613 - RNA, 1701 nt, Artificial Sequence
  derived and/or modified sequence opt5 from hemagglutinin__InfluenzaA__AFN19972
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacaaugaagaacugcgggagcagcuuuccagcgucucuuccuucgaacgcuuugagaucuuccccaagaccagcucuuggccuaaccacgauuccaauaagggagugacagccgcuuguccccaugccggcgcgaaaucuuuuuacaagaaccugaucuggcucguuaaaaagggcaauagcuauccuaaacuguccaagagcuacauuaacgacaaggggaaagaagugcuuguccuguggggaauccaccaccccuccaccacagccgaucaacagucucucuaucagaaugcugacaccuacguguucgugggcacgagcagauacuccaagaaauuuaagccugagauugccauccggccgaaaguccgcgaucaggaggggagaaugaacuauuacuggacacugguugaacccggagacaagauuaccuucgaggcuacaggcaaccugguggugccucgguaugccuuugcgauggaacgcaaugccgggagcggaaucauuaucucugauacccccguccaugacugcaacaccacaugucaaacgccuaaaggcgcuaucaauaccucccuccccuuccagaacauucacccgaucacaauuggcaagugcccuaaguacgugaaaagcaccaagcugagacuugccacagggcugcggaauguucccucuauccagagccgcggacucuuuggcgcuauugccggguucaucgagggaggcuggaccgggaugguggacggaugguauggcuaccaucaccagaacgaacaaggcuccggguaugccgcugaucugaaaucuacgcagaaugcgaucgacaagauuacaaacaaagucaauagcgugaucgagaagaugaacacccaguuuaccgccguuggaaaggaguucaaucaccuugagaaaagaauugagaaccugaauaagaaaguggaugacggcuuccucgauaucuggacauacaacgcugaacugcugguccuccuggagaaugaacggacccuugacuaccaugauuccaacgugaagaaccuguaugagaaaguccgcaaucagcucaagaacaaugccaaggagauugggaacggauguuuugaguucuaccacaaaugcgacaauacauguauggaaagcgugaagaacggcacguaugauuacccuaaauauucugaagaggccaagcugaauagagaagagaucgacgggguuaaacuugaguccacccggguguaccaaauccuggcuauuuauagcacagucgccucuucccucgugcugguugugagccugggcgcgaucuccuuuuggaugugcucuaacggaagccuccagugccgcauuuguaucuga

SEQ ID NO: 192614 - RNA, 1701 nt, Artificial Sequence
  derived and/or modified sequence opt5 from hemagglutinin__InfluenzaA__AFN19978
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucugcccuuccagaauauucacccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaucaccagaaugaacaagggagcggauacgccgcugaucucaaauccacgcagaacgcgaucgacaagauuacaaauaaagucaacucugugaucgagaagaugaauacccaguuuaccgccguuggcaaggaguucaaccaccuggaaaagagaauugagaaucuuaacaagaaaguggaugacggguuccuggauaucuggacauacaaugcugaacuccugguccugcucgagaacgaacggacccuggacuaucaugauagcaaugugaagaaccuuuacgagaaaguccgcaaccagcugaagaauaacgccaaggagauuggaaauggcuguuuugaguucuaucacaaaugcgacaacacauguauggaguccgugaagaaugggacguacgauuauccuaaauacagcgaagaggccaagcucaacagagagaaaaucgacggcguuaagcuggaaucuacccggaucuaucaaauucuugcuaucuacuccacaguggccagcucucugguccucgugguuucccugggagcgauuagcuuuuggaugugcuccaauggcucucugcagugccgcaucuguauuuga

SEQ ID NO: 192615 - RNA, 1701 nt, Artificial Sequence; identical to SEQ ID NO: 189839
  derived and/or modified sequence opt5 from hemagglutinin__InfluenzaA__AFN19983

SEQ ID NO: 192616 - RNA, 1701 nt, Artificial Sequence
  derived and/or modified sequence opt5 from hemagglutinin__InfluenzaA__AFN19993
augaaggccauccuggugguccuccuguacaccguugcuacaacgaacgccgacacccuuugcauuggcuaucacgcgaauaacagcacagauaccguggacacagugcuggagaaaaaugucaccgugacacauuccguuaaccuccuggaagauaagcacaaugggaaacuuuguaagcugagaggaguggcuccccuccaucugggcaaaugcaacaucgccggguggauucugggaaauccugagugugaaucucucagcaccgccuccucuuggagcuacaucgucgagacguccucuagcgacaacgggaccugcuauccgggcgauuucauugacuacgaagaacugcgggagcagcuuuccagcgugucuuccuuugaacgcuucgagaucuuucccaagacaagcucuuggccuaaucacgauuccaacaagggaguuaccgcugccuguccccaugcuggcgccaaaggcuucuauaagaaucugaucuggcucgugaaaaaggggaacagcuacccuaaacugucuaaguccuauauuaaugacaagggaaaagaaguccuugugcuguggggcauccaccaccccagcacaaccgcggaucaacagucccucuaccagaacgccgacacguacguguuugucgggacaucuagauauagcaagaaauucaagccugagauugcuauccggccgaaaguucgcgaucaggagggaagaaugaauuacuauuggacccugguggaacccggcgacaagauuacauuugaggccaccgggaaccugguggucccucgguacgcuuucgccauggaacgcaacgcgggauccggcaucauuaucagcgauacccccgugcaugacugcaauacaacgugucaaaccccuaaaggcgccaucaacacaucucuccccuuucagaauauucacccgaucaccauugggaagugcccuaaguauguuaaauccacaaagcugagacuugcuaccggacugcggaacgugcccagcauccagucucgcggccucuucggggccauugcuggauuuaucgagggcggguggacgggaauggucgacggcugguacggcuaucaucaccagaaugaacaagggagcggauacgccgccgaucugaaauccacacagaacgcuaucgacaagauuaccaauaaagugaacucuguuaucgagaagaugaauacccaguucacagcggugggcaaggaguuuaaccaccuugagaaaagaauugagaaucugaacaagaaagucgaugacggguuccucgauaucuggaccuacaaugccgaacugcuggugcuccuggagaacgaacggacacuugacuaucaugauagcaaugucaagaaccuguacgagaaagugcgcaaccagcucaagaauaacgcuaaggagauuggaaauggcuguuucgaauuuuaucacaaaugcgacaacacguguauggaguccguuaagaaugggaccuacgauuauccuaaauacagcgaagaggccaagcugaacagagaagagaucgacggcgugaaacuugagucuacacggaucuaucaaauucuggccaucuacuccaccgucgcuagcucucucgugcugguugugucccugggagccauuagcuucuggaugugcuccaauggcucucuccagugccgcaucuguauuuga

SEQ ID NO: 192617 - RNA, 1701 nt, Artificial Sequence; identical to SEQ ID NO: 189839
  derived and/or modified sequence opt5 from hemagglutinin__InfluenzaA__AFN20000

SEQ ID NO: 192618 - RNA, 1701 nt, Artificial Sequence; identical to SEQ ID NO: 189846
  derived and/or modified sequence opt5 from hemagglutinin__InfluenzaA__AFN20006

SEQ ID NO: 192619 - RNA, 1701 nt, Artificial Sequence; identical to SEQ ID NO: 189478
  derived and/or modified sequence opt5 from hemagglutinin__InfluenzaA__AFN20012

SEQ ID NO: 192620 - RNA, 1701 nt, Artificial Sequence
  derived and/or modified sequence opt5 from hemagglutinin__InfluenzaA__AFN20018
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaacagcuauauuaaugauaaggggaaggaagugcuuguccuguggggaauccaucaccccuccaccucugccgaccagcagagccucuaccagaacgcugaugccuacguguucgugggcacauccaaauauagcaagaaauuuaagccugagauugcugucagaccgaaaguucgggaccaagaggggcgcaugaacuacuauuggacccugguggaacccggagauaagaucacguucgaggccacaggcaaucugcucgugccuagauacgcguuugccauggaacggaacgcugggucuggaauuaucauuuccgacacccccguccacgauugcaauacaaccugucagaccccuaaaggcgccaucaacacaagccugcccuuccagaauauccauccgauuacgaucggcaagugcccuaaguaugugaaaucuaccaaacuucgccuggcuacagggcucagaaacguucccagcauucagucccggggacuguuuggcgccaucgccggguucauugagggaggcuggaccgggaugguggacggaugguacggcuaucaccaucaaaaugcucagggcucuggguacgcggccgaccuuaagagcacacagaacgcuaucgauaagaucaccaauaaagucaacuccgugauugaaaagaugaauacgcaguuuacagccguuggaaaggaguucaaccaccuggagaaacgcaucgaaaaucucaacaagaaaguggacgauggcuuccuggacauuuggaccuacaaugccgagcugcucguccugcuugaaaacgagagaacccuggauuaucacgacagcaacgugaagaaucucuacgaaaaaguccggucucaacugaagaacaaugcuaaggagaucgggaacggauguuuugaguucuaucauaaaugcgauaauacauguauggaauccgugaagaacggcaccuacgacuauccuaaauacagcgaggaagccaaacuuaaucgcgaggaaauugaugggguuaagcuggagucuacaagaaucuaucagauccucgcgauuuacuccacgguggcuagcucccugguccuggugguuucucucggcgccaucagcuuuuggaugugcuccaacggaucucugcagugccggauuuguaucuga

SEQ ID NO: 192621 - RNA, 1701 nt, Artificial Sequence; identical to SEQ ID NO: 189848
  derived and/or modified sequence opt5 from hemagglutinin__InfluenzaA__AFN20019

SEQ ID NO: 192622 - RNA, 1701 nt, Artificial Sequence; identical to SEQ ID NO: 189478
  derived and/or modified sequence opt5 from hemagglutinin__InfluenzaA__AFN20021

SEQ ID NO: 192623 - RNA, 1701 nt, Artificial Sequence; identical to SEQ ID NO: 189848
  derived and/or modified sequence opt5 from hemagglutinin__InfluenzaA__AFN20034

SEQ ID NO: 192624 - RNA, 1701 nt, Artificial Sequence; identical to SEQ ID NO: 189839
  derived and/or modified sequence opt5 from hemagglutinin__InfluenzaA__AFN20040

SEQ ID NO: 192625 - RNA, 1701 nt, Artificial Sequence; identical to SEQ ID NO: 192611
  derived and/or modified sequence opt5 from hemagglutinin__InfluenzaA__AFN20046

SEQ ID NO: 192626 - RNA, 1701 nt, Artificial Sequence; identical to SEQ ID NO: 189848
  derived and/or modified sequence opt5 from hemagglutinin__InfluenzaA__AFN20052

SEQ ID NO: 192627 - RNA, 1701 nt, Artificial Sequence; identical to SEQ ID NO: 189848
  derived and/or modified sequence opt5 from hemagglutinin__InfluenzaA__AFN20061

SEQ ID NO: 192628 - RNA, 1701 nt, Artificial Sequence
  derived and/or modified sequence opt5 from hemagglutinin__InfluenzaA__AFN20076
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugacugugagucucucagcacagccuccucuuggagcuacaucguggaaaccuccucuagcgauaacggcacgugcuauccgggggacuuuauugauuacgaggaacugcgggagcagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccacagccgaccaacagucucucuaccagaacgcugauaccuacguguucgugggcacgagcagauauuccaagaaauuuaagccugaaauugccauccggccgaaaguccgcgaccaggaggggagaaugaauuacuauuggacacugguugagcccggagauaagauuaccuucgaagcuacaggcaaccugguggugccucgguacgccuuugcgauggagcgcaacgccgggagcggaaucauuaucucugacacccccguccaugacugcaauaccacaugucaaacgccuaaaggcgcuaucaacaccucccuccccuuccagaauauucacccgaucacaauuggcaagugcccuaaguaugugaaaagcaccaagcugagacuugccacagggcugcggaacguucccucuauccagagccgcggacucuuuggcgcuauugccggguucaucgaaggaggcuggaccgggaugguggauggaugguacggcuaucaucaccagaaugagcaaggcuccggguacgccgcugaccugaaaucuacgcagaacgcgaucgauaagauuacaaauaaagucaacagcgugaucgaaaagaugaauacccaguuuaccgccguuggaaaggaguucaaccaccuugagaaaagaauugaaaaucugaacaagaaaguggacgauggcuuccucgacaucuggacauacaaugcugagcugcugguccuccuggaaaacgagcggacccuugauuaucaugacuccaaugugaagaaccuguacgaaaaaguccgcaaccagcucaagaauaacgccaaggagacagggaauggauguuuugaguucuaucacaaaugcgauaacacguguauggaaagcgugaagaauggcaccuacgacuauccuaaauacucugaggaagccaagcugaacagagaggaaauugaugggguuaaacuugaguccacacggaucuaucaaauccuggcuauuuacagcaccguggccucuucccucguccuggugguuagccugggcgcgaucuccuuuuggaugugcucuaauggaagccuccagugccgcauuuguaucuga

SEQ ID NO: 192629 - RNA, 1701 nt, Artificial Sequence
  derived and/or modified sequence opt5 from hemagglutinin__InfluenzaA__AFN20081
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaaauuuccaagagcuauaucaaugacaaggggaaagaagugcugguccuuuggggcauucaccaccccuccaccacagccgaucaacagucucuguaccagaacgcugacaccuacguguucgugggaacgagcagauauuccaagaaauuuaagccugagaucgccauucggccgaaaguccgcgaucaggaggggagaaugaauuacuauuggacacucguugaacccggagacaagaucaccuucgaggcuacaggcaaccuggugauuccucgguacgccuuugcgauggaacgcaacgccgggagcggaaucaucauuucugauacccccgugcaugacugcaauaccacaugucaaacgccuaaaggcgcuaucaacaccucccugcccuuccagaauauucacccgaucacaauuggcagaugcccuaaguaugucaagagcaccaaacuccggcuggccacagggcuucgcaacgugcccucuauccagagcagaggacuguuuggcgcuaucgccggguucauugagggaggcuggaccgggaugguugacggaugguacggcuaucaucaccagaaugaacaaggcuccggguacgccgcugaucucaagucuacgcagaacgcgaucgacaaaauuacaaauaaggugaacagcgucaucgagaaaaugaauacccaguuuaccgccgugggaaaggaguucaaccaccuggaaaagcggauugagaaucuuaacaaaaagguugaugacggcuuccuggauaucuggacauacaaugcugaacuccuggugcugcucgagaacgaacgcacccuggacuaucaugauuccaaugucaaaaaccuuuacgagaaggugagaaaccagcugaaaaauaacgccaaggagacagggaauggauguuuugaguucuaucacaagugcgacaacacguguauggagagcgucaaaaauggcaccuacgauuauccuaaguacucugaagaggccaaacucaaccgggaagugaucgacgggguuaagcuggaguccacacgcauuuaucaaauccuugcuauuuacagcaccguggccucuucccugguccucgugguuagccugggcgcgaucuccuuuuggaugugcucuaauggaagccugcagugcagaauuuguaucuga

SEQ ID NO: 192630 - RNA, 1701 nt, Artificial Sequence; identical to SEQ ID NO: 189848
  derived and/or modified sequence opt5 from hemagglutinin__InfluenzaA__AFN20092

SEQ ID NO: 192631 - RNA, 1701 nt, Artificial Sequence; identical to SEQ ID NO: 192610
  derived and/or modified sequence opt5 from hemagglutinin__InfluenzaA__AFN20099

SEQ ID NO: 192632 - RNA, 1701 nt, Artificial Sequence
  derived and/or modified sequence opt5 from hemagglutinin__InfluenzaA__AFN20112
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugaguguaagucucucagcacagccuccucuuggagcuacaucguggaaaccuccucuagcgacaacggcacgugcuauccgggggauuuuauugacuacgaggaacugcgggagcagcuuuccagcgucucuuccuucgagcgcuuugaaaucuuccccaagaccagcucuuggccuaaucacaaccccaauaaaggagugacagccgcuuguccucaugccggcgcgaaguccuuuuauaaaaaccugaucuggcucguuaagaauggcaacagcuaccccaaacugaauaccucuuauauuaacgauaaggggaaggaggugcuuguccuguggggaauccaccacccuuccacaagcgccgaccaacagucccucuaccagaacgcugaugccuacgcuuucgugggcaccucuagauauagcaaaaaguuuaaaccggaaauugccauccggcccaaggugcgcgaccaggaggggagaaugaauuacuauuggacgcuggucgagccuggagauaaaauuacauucgaagcgaccggcaaccugguugugccccgguacgccuuugcuauggagcgcaaugccggguccggaaucauuaucagcgacacaucugugcaugauugcaacaccaccugucaaacaccuaagggcgcuaucaauacgucccuccccuuccagaacguccacccgauuaccaucggcaaaugcccuaaguauguuaagagcacaaaacugagacuugccaccgggcugcggaaugugcccucuauucagagccgcggacucuuuggcgccaucgcuggguucauugaaggaggcuggacagggaugguggacggaugguacggcuaucaucaccagaacgagcaaggcuccggguacgcggccgaccugaagucuacccagaaugcuuuugauaaaaucacgaacaaggucaauagcgugaucgaaaagaugaacacacaguucaccgccguuggaaaggaguucaaucaccuugagaagagaauugaaaaccugaauaaaaagguggacgauggcuuucucgacaucuggaccuacaacgccgagcugcugguccuccuggaaaacgagcggacacuugauuaucaugacuccaaugugaaaaaccuguacgaaaagguccgcagccagcucaaaaccaaugcuaaggagauugggaacggauguuucgaguuuuaucacaagugcgauaauacauguauggaaucugugaaaaacggcacguacgacuauccuaaguacuccgaggaagccaaacugaauagagaggaaaucgaugggguuaaacuugagagcacccggauuuaucaaauccuggcgaucuacucuacaguggcuuccagccucguccuggugguuucccugggcgccauuucuuucuggaugugcagcaacggaucccuccagugccgcaucuguauuuga

SEQ ID NO: 192633 - RNA, 1701 nt, Artificial Sequence
  derived and/or modified sequence opt5 from hemagglutinin__InfluenzaA__AFN87924
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauauuaaugacaagagaaaggaagugcuuguccugugggggauccaccacccuagcacauccgccgaucaacagucucucuaccagaacgcugacgccuacgcuuucgugggaaccagccgguauuccaaaaaguuuaaaccggagauugccauccgccccaaggugagagaucaggagggccggaugaauuacuauuggacgcuggucgaaccuggggacaaaauuacauucgaggcgaccggaaaccugguugugccccgcuacgccuuugcuauggaaagaaacgccggcagcgggaucauuaucucugauacauccgugcaugacugcaauaccaccugucaaacaccuaagggagcuaucaacacgagccuccccuuccagaauguccacccgauuaccaucggcaaaugcccuaaguaugugaagucuacaaaacugcggcuugccaccggccugcgcaacguucccagcauucaguccagagggcucuuuggagccaucgcuggcuucauugaagggggauggacaggcaugguggacgggugguacggauaucaucaccagaaugaacaaggcucuggcuacgcggccgaucuuaagagcacccagaacgcuuuugacaaaaucacgaauaaggucaacuccgugaucgagaaaaugaauacacaguucaccgccguugggaaggaguucaaccaccuugaaaagcggauugagaaucugaacaaaaagguggaugacggauuucucgauaucuggaccuacaaugccgaacugcugguccuccuggagaacgaacgcacacuugacuaucaugauagcaaugugaaaaaccuguacgagaaggucagaucucagcucaaaaacaaugcuaaggagauuggcaacggguguuucgaauuuuaucacaagugcgacaauaccuguauggaguccgugaaaaacggaacauacgauuauccuaaguacagcgaagaggccaaacugaaucgggaagagaucgacggcguuaagcuggagucuacgcgcauuuaucaaauccuggcgaucuacuccaccguggcuagcucccucguccuggugguuucucugggggccauuagcuucuggaugugcuccaacggcucucuccagugcagaaucuguauuuga

SEQ ID NO: 192634 - RNA, 1701 nt, Artificial Sequence; identical to SEQ ID NO: 185693
  derived and/or modified sequence opt5 from hemagglutinin__InfluenzaA__AFN87926

SEQ ID NO: 192635 - RNA, 1701 nt, Artificial Sequence
  derived and/or modified sequence opt5 from hemagglutinin__InfluenzaA__AFN87927
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaagagaaaagaagugcuuguccugugggggauccaccaccccuccaccucugccgaucaacagagccucuaccagaacgcugacgccuacguguucgugggaacaucccgguauagcaagaaauuuaagccugagauugcuauccgcccgaaagucagagaucaggagggccggaugaauuacuauuggacccugguugaacccggggacaagauuacguucgaggccacaggaaaccugguggugccucgcuacgcguuugccauggaaagaaacgcuggcucugggaucauuaucuccggaacccccguccaugauugcaauacaaccugucaaaccccuaaaggcgccaucaacacaagccuccccuuccagaauauucacccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaccugaaaagcacacagaacgccaucgauaagauuaccaaucgggucaacuccgugaucgagaaaaugaauacgcaguuuacagcuguuggaaaggaguucaaccaccuugaaaagcgcauugagaaucugaacaaaaagguggacgauggcuuccucgacaucuggaccuacaaugccgaacugcugguccuccuggagaacgaaagaacccuugauuaucaugacagcaaugugaaaaaccuguacgagaagguccggucucagcucaaaaacaaugccaaggagauugggaacggauguuuugaguucuaucacaagugcgauaauacauguauggaguccgugaaaaacggcaccuacgacuauccuaaguacagcgaagaggcuaaacugaaucgcgaagagaucgaugggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 192636 - RNA, 1701 nt, Artificial Sequence
  derived and/or modified sequence opt5 from hemagglutinin__InfluenzaA__AFN87928
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccaugacugcaauacaaccugucagaccccuaaaggcgccaucaacacaagccuccccuuccaaaauauucacccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaucaccagaaugaacagggcucuggguacgcugcggaucugaaaagcacacaaaacgccaucgacaagauuaccaauaaagucaacuccgugaucgagaagaugaauacgcaguuuacagcuguuggaaaggaguucaaccaccuugaaaaacggauugagaaucugaacaagaaaguggaugacggcuuccucgauaucuggaccuacaaugccgaacugcugguccuccuggagaacgaacgcacccuugacuaucaugauagcaaugugaagaaccuguacgagaaagucagaucucagcucaagaacaaugccaaggagauugggaacggauguuuugaguucuaucacaaaugcgacaauacauguauggaguccgugaagaacggcaccuacgauuauccuaaauacagcgaagaggcuaagcugaaucgggaagagaucgacgggguuaaacuugagucuacacgcaucuaucagauucuggccaucuacuccacgguggcgagcucccucguccuggcugugucucugggcgccauuagcuuuuggaugugcuccaacggaucucuccaaugcagaaucuguauuuga

SEQ ID NO: 192637 - RNA, 1701 nt, Artificial Sequence; identical to SEQ ID NO: 186857
  derived and/or modified sequence opt5 from hemagglutinin__InfluenzaA__AFN87929

SEQ ID NO: 192638 - RNA, 1701 nt, Artificial Sequence; identical to SEQ ID NO: 186857
  derived and/or modified sequence opt5 from hemagglutinin__InfluenzaA__AFN87930

SEQ ID NO: 192639 - RNA, 1701 nt, Artificial Sequence
  derived and/or modified sequence opt5 from hemagglutinin__InfluenzaA__AFN87931
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagagaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgauaacggcacgugcuauccgggggacuuuauugauuacgaggagcugcgggaacagcuuuccagcgucucuuccuucgagcgcuuugaaaucuuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauauuaaugauaaggggaaagaggugcuuguccuguggggaauccaccaccccuccaccucugccgaccaacagagcauuuaccagaacgcugaugccuacguguucgugggcacauccagauauagcaagaaauuuaagccugagaucgcuauucggccgaaaguccgcgaccaggaagggagaaugaauuacuauuggacccucguugagcccggagauaagaucacguucgaagccacaggcaaccugguggugccucgguacgcguuuaccauggagcgcaacgccgggucuggaauuaucaucuccgacacacccguccaugauugcaauaccaccugucaaacaccuaaaggcgcuauuaacacgagccugcccuuccagaauauccacccgauuaccaucggcaagugcccuaaguaugugaaaucuacaaagcucagacuggccaccgggcuucggaacguucccagcauucagucccgcggacuguuuggcgcuaucgccggguucaucgaaggaggcuggacagggaugguggacggaugguacggcuaucaucaccagaaugagcaaggcucuggguacgccgcugaccucaaaagcacccagaacgcgauugauaagaucacgaauaaagucaacuccgugauugagaagaugaauacacaguuuaccgccguuggaaaggaauuuaaccaccuggagaaaagaaucgaaaaucuuaacaagaaaguggacgauggcuuccuggacauuuggaccuacaaugcugagcuccugguccugcucgaaaacgagcggacacuggauuaucaugacagcaaugugaagaaccuuuacgagaaaguccgcucucagcugaagaacaaugccaaggaaaucgggaacggauguuucgaguucuaucacaaaugcgauaauaccuguauggaauccgugaagaacggcacauacgacuauccuaaauacagcgaggaagccaagcucaauagagaggagaucgaugggguuaaacuggaaucuacgcggauuuaucaaauccuugcuauuuacuccaccguggccagcucccugguccucgugguuucucugggcgcgaucagcuuuuggaugugcuccaacggaucucugcagugccgcauuuguaucuga

SEQ ID NO: 192640 - RNA, 1701 nt, Artificial Sequence
  derived and/or modified sequence opt5 from hemagglutinin__InfluenzaA__AFN87932
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgauagagaagggcggaugaauuacuauuggacacugguugagcccggagacaaaauuaccuucgaagccacgggcaaccugguggugccucgcuacgcguuugccauggagagaaacgcuggguccggaaucauuaucagcgauacacccguccaugacugcaauaccacaugucagaccccuaagggcgccaucaacaccucucuccccuuccacaauauucauccgaucacaauuggcaaaugcccuaaguauguuaagagcacgaaacugcggcuugcuaccgggcugcgcaacgugcccuccauccaaucuagaggacucuuuggcgccauugccggguucaucgaaggaggcuggacagggaugguggacggaugguacggcuaucaccaccagaaugagcagggcagcggguacgcugcggaucugaaguccacccagaacgccaucgacgagauuacaaauaaagucaacagcgugaucgaaaagaugaauacccaauuuacggcuguuggaaaagaguucaaccaucuugaaaagcggauugagaaucugaacaagaaaguggaugacggcuuccucgauaucuggacauacaaugccgaacugcugguccuccuggagaacgagcgcacccuugacuaucacgauucuaaugugaagaaccuguacgaaaaagucagaucccagcucaagaacaaugccaaagagauugggaacggauguuuugaguucuaucauaagugcgacaauaccuguauggaaagcgugaagaacggcacauacgauuauccuaaauacucugaagaggcuaagcugaaucgggaggaaaucgacgggguuaaacuugaguccacccgcaucuaucagauucuggccaucuacagcacaguggcguccucucucguccuggugguuagccugggcgcuauuuccuuuuggaugugcucuaacggaagccuccagugcagaaucuguauuuga

SEQ ID NO: 192641 - RNA, 1701 nt, Artificial Sequence; identical to SEQ ID NO: 186857
  derived and/or modified sequence opt5 from hemagglutinin__InfluenzaA__AFN87933

SEQ ID NO: 192642 - RNA, 1701 nt, Artificial Sequence
  derived and/or modified sequence opt5 from hemagglutinin__InfluenzaA__AFN87934
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcagcucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcaacuguccagcgucucuuccuucgaacgcuuugagaucuuccccaagaccagcucuuggccuaaucaugauuccaacaagggagugacagccgcuuguccccacgccggcgcgaaaggcuuuuauaagaaucuuaucuggcugguuaaaaaggggaacagcuacccuaaacucucuaaguccuauauuaaugacaagggaaaagaagugcugguccuuuggggcauccaucaccccagcaccuccgccgaucagcagucucuguaccagaacgcugacacauacguguucguggggaccagcagauauuccaagaaauuuaagccugagauugccauccggccgaaaguccgcgaucaagagggaagaaugaauuacuauuggacgcucguugaacccggcgacaagauuacauucgaggcuaccgggaaccugguggugccucgguacgccuuugcgauggaacgcaacgccggaagcggcaucauuaucucugauacacccguccacgacugcaauaccaccugucagacaccuaaaggcgcuaucaacacgucccugcccuuccagaauauucauccgaucaccauugggaagugcccuaaguaugugaaaagcacaaagcucagacuggccaccggacuucggaacguucccucuauccagagccgcggccuguuuggggcuauugccggauucaucgagggcggguggacaggaaugguggacggcugguacggcuaucaccaucaaaaugaacagggguccggauacgccgcugaucucaaaucuacccagaacgcgaucgacaagauuacgaauaaagucaacagcgugaucgagaagaugaauacacaguuuaccgccguuggcaaggaguucaaccaccuggaaaagagaauugagaaucuuaacaagaaaguggaugacggguuccuggauaucuggaccuacaaugcugaacuccugguccugcucgagaacgaacggacacuggacuaucacgauuccaaugugaagaaccuuuacgagaaaguccgcagccaacugaagaacaaugccaaggagauuggaaacggcuguuuugaguucuaucauaaaugcgacaauaccuguauggagucugugaagaacgggacauacgauuauccuaaauacuccgaagaggccaagcucaauagagaagagaucgacggcguuaaacuggagagcacgcggaucuaucagauucuugcuaucuacucuaccguggccuccagccugguccucgugguuucccugggagcgauuucuuuuuggaugugcagcaacggcucccugcagugccgcaucuguauuuga

SEQ ID NO: 192643 - RNA, 1701 nt, Artificial Sequence
  derived and/or modified sequence opt5 from hemagglutinin__InfluenzaA__AFN87936
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaggaacugcgggagcagcuuagcuccgucagcucuuucgaacgcuuugagaucuuccccaagaccuccagcuggccuaaucacgaucccaacaagggagugacagccgcuuguccucaugccggcgcgaaaucuuuuuauaagaaucugauuuggcucguuaaaaagggcaacuccuaccccaaacugagcaccucuuauaucaaugacaaggggaaggaagugcuuguccuguggggcauucaccacccuuccacaagcgccgaucaacagucccucuaccagaacgcugacgccuacgcuuucgugggaaccucuagauauagcaaaaaguuuaaaccggagaucgccauucggcccaaggugcgcgaucaggaggggagaaugaauuacuauuggacgcuggucgaaccuggagacaaaaucacauucgaggcgaccggcaaccugguugugccccgguacgccuuugcuauggaacgcaacgccggguccggaauuaucaucagcgauacaucugugcaugacugcaauaccaccugucaaacaccuaagggcgcuauuaacacgucccuccccuuccagaauguccacccgaucaccauuggcaaaugcccuaaguauguuaagagcacaaaacugagacuugccaccgggcugcggaucgugcccucuauucagagccgcggacucuuuggcgccaucgcuggguucaucgagggaggcuggacagggaugguggacggaugguacggcuaucaucaccagaacgaacaaggcuccggguacgcggccgaucugaagucuacccagaaugcuuuugacaaaauuacgaacaaggucaauagcgugaucgagaaaaugaacacacaguucaccgccguuggaaaggaguucaaucaccuugaaaagagaauugagaaccugaauaaaaagguggaugacggcuuucucgauaucuggaccuacaacgccgaacugcugguccuccuggagaaugaacggacacuugacuaucaugauuccaacgugaaaaaucuguacgagaagguccgcagccagcucaaaaacaacgcuaaggagauugggaauggauguuucgaauuuuaucacaagugcgacaacaccuguauggagucugugaaaaauggcacauacgauuauccuaaguacuccgaagaggccaaacugaacagagaagagaucgacgggguuaaacuugagagcacgcggaucuaucaaauucuggcgaucuacucuaccguggcuuccagccucguccuggugguuucccugggcgccauuucuuucuggaugugcagcaauggaucccuccagugccgcaucuguauuuga

SEQ ID NO: 192644 - RNA, 1701 nt, Artificial Sequence
  derived and/or modified sequence opt5 from hemagglutinin__InfluenzaA__AFN87938
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaaccuccaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcaaccagcucaaaaauaacgccaaggaaauugggaauggauguuuugaguucuaucacaagugcgacaacacauguauggaaucugugaaaaauggcaccuacgauuauccuaaguacuccgaggaagcuaaacugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 192645 - RNA, 1701 nt, Artificial Sequence
  derived and/or modified sequence opt5 from hemagglutinin__InfluenzaA__AFN87939
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauauuaaugacaaggggaaggaagugcuuguccuguggggaauccaccacccuagcacauccgccgaucaacagucucucuaccagaacgcugacgccuacgcuuucgugggcaccagcagauauuccaaaaaguuuaaaccggagauugccauccggcccaaggugcgcgaucaggaggggagaaugaauuacuauuggacgcuggucgaaccuggagacaaaauuacauucgaggcgaccggcaaccugguugugccccgguacgccuuugcuauggaacgcaacgccgggagcggaaucauuaucucugauacauccgugcaugacugcaauaccaccugucaaacaccuaagggcgcuaucaacacgagccuccccuuccagaauguccacccgauuaccaucggcaaaugcccuaaguaugugaagucuacaaaacugagacuugccaccgggcugcggaacguucccagcauucagucccgcggacucuuuggcgccaucgcuggguucauugagggaggcuggacagggaugguggacggaugguacggcuaucaucaccagaaugaacaaggcucuggguacgcggccgaucuuaagagcacccagaacgcuaucgacgagaucacgaauaaagucaacuccgugauugagaagaugaauacacaguuuaccgccguuggaaaagaguucaaccaccuggagaagagaaucgaaaaucugaacaagaaaguggaugacggcuuccucgauauuuggaccuacaaugccgagcugcugguccuccuggaaaacgagcggacacuugacuaucaugauagcaaugugaagaaccuguacgagaaaguccgcucucagcucaagaacaaugcuaaagaaaucgggaacggauguuuugaguucuaucacaagugcgacaauaccuguauggaauccgugaagaacggcacauacgauuauccuaaauacagcgaggaagccaagcugaauagagaggagauugacgggguuaaacuugaaucuacgcggaucuaucaaauccuggcgauuuacuccaccguggcuagcucccucguccuggugguuucucugggcgccaucagcuuuuggaugugcuccaacggaucucuccagugccgcauuuguaucuga

SEQ ID NO: 192646 - RNA, 1701 nt, Artificial Sequence
  derived and/or modified sequence opt5 from hemagglutinin__InfluenzaA__AFN87941
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcaaccagcucaaaaauaacgccaaggaaauugggaauggauguuuugaguucuaucacaagugcgacaacacauguauggaaagcgugaaaaauggcaccuacgauuaucccaaguacucugaggaagcuaaacugaacagagaggagaucgacgggguuaaacuugaauccacacggaucuaucaaauucuggccaucuacagcacgguggcgucuucccucguccuggugguuagccugggcgcuauuuccuuuuggaugugcucuaauggaagccuccagugccgcaucuguauuuga

SEQ ID NO: 192647 - RNA, 1701 nt, Artificial Sequence
  derived and/or modified sequence opt5 from hemagglutinin__InfluenzaA__AFN87943
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgaucccaacaagggagugacagccgcuuguccucaugccggcgcgaaaucuuuuuauaagaaucugauuuggcucguuaaaaagggcaacuccuaccccaaacugagcaccucuuauaucaaugacaaggggaaggaagugcuuguccuguggggcauucaccacccuuccacaagcgccgaucaacagucccucuaccagaacgcugacgccuacgcuuucgugggaaccucuagauauagcaaaaaguuuaaaccggagaucgccauucggcccaaggugcgcgaucaggaggggagaaugaauuacuauuggacgcuggucgaaccuggagacaaaaucacauucgaggcgaccggcaaccugguugugccccgguacgccuuugcuauggaacgcaacgccggguccggaauuaucaucagcgauacaucugugcaugacugcaauaccaccugucaaacaccuaagggcgcuauuaacacgucccuccccuuccagaauguccacccgaucaccauuggcaaaugcccuaaguauguuaagagcacaaaacugagacuugccaccgggcugcggaacgugcccucuauccagagccgcggacucuuuggcgccauugcuggguucaucgagggaggcuggacagggaugguggacggaugguacggcuaucaucaccagaaugaacaaggcuccggguacgcggccgaucugaagucuacccagaacgcuaucgacgagauuacgaauaaagucaacagcgugaucgagaagaugaauacacaguuuaccgccguuggaaaagaguucaaccaccuugagaagagaauugaaaaucugaacaagaaaguggaugacggcuuccucgauaucuggaccuacaaugccgagcugcugguccuccuggaaaacgagcggacacuugacuaucaugauuccaaugugaagaaccuguacgagaaaguccgcagccagcucaagaacaaugcuaaagaaauugggaacggauguuuugaguucuaucacaagugcgacaauaccuguauggaaucugugaagaacggcacauacgauuauccuaaauacuccgaggaagccaagcugaauagagaggagaucgacgggguuaaacuugaaagcacgcggaucuaucaaauucuggcgaucuacucuaccguggcuuccagccucguccuggugguuucccugggcgccauuucuuuuuggaugugcagcaacggaucccuccagugccgcaucuguauuuga

SEQ ID NO: 192648 - RNA, 1701 nt, Artificial Sequence
  derived and/or modified sequence opt5 from hemagglutinin__InfluenzaA__AFN87945
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccucugccgaccagcagagccucuaccagaaugcugaugccuacguguucgugggcacauccagauauagcaaaaaguuuaaaccugagauugcuauccggccgaagguccgcgaccaagaggggagaaugaacuacuauuggacccugguugaacccggagauaaaauuacguucgaggccacaggcaaucugguggugccucgguacgcguuugccauggaacgcaacgcugggucuggaaucauuaucuccgacacccccguccaugacugcaacacaaccugucagaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggauggaugguacggcuaucaucaccaaaacgaacagggcucuggguacgcugcggaccuuaagagcacacagaaugccaucgauaaaauuaccaacaaggucaauuccgugaucgagaaaaugaacacgcaguuuacagcuguuggaaaggaguucaaucaccuugaaaagagaauugagaaccugaauaaaaagguggacgauggcuuccucgacaucuggaccuacaacgccgaacugcugguccuccuggagaaugaacggacccuugauuaucaugacagcaacgugaaaaaucuguacgagaagguccgcucucaacucaaaaacaacgccaaggagauugggaauggauguuuugaguucuaucacaagugcgauaacacauguauggaguccgugaaaaauggcaccuacgacuauccuaaguacagcgaagaggcuaaacugaacagagaagagaucgaugggguuaagcuggagucuacacggaucuaucagauucuggccaucuacuccacgguggcgagcucccucguccuggugguuucucugggcgcuauuagcuuuuggaugugcuccaauggaucucuccagugccgcaucuguauuuga

SEQ ID NO: 192649 - RNA, 1701 nt, Artificial Sequence
  derived and/or modified sequence opt5 from hemagglutinin__InfluenzaA__AFN87947
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaccuccuauauuaaugacaaggggaaggaagugcuuguccuguggggaauccaccacccuagcacauccgccgaucaacagucucucuaccagaacgcugacgccuacgcuuucgugggcaccagcagauauuccaaaaaguuuaaaccggagauugccauccggcccaaggugcgcgaucaggaggggagaaugaauuacuauuggacgcuggucgaaccuggagacaaaauuacauucgaggcgaccggcaaccugguugugccccgguacgccuuugcuauggaacgcaacgccgggagcggaaucauuaucucugauacauccgugcaugacugcaauaccaccugucaaacaccuaagggcgcuaucaacacgagccuccccuuccagaauguccacccgauuaccaucggcaaaugcccuaaguaugugaagucuacaaaacugagacuugccaccgggcugcggaacguucccagcauucagucccgcggacucuuuggcgccaucgcuggguucauugagggaggcuggacagggaugguggacggaugguacggcuaucaucaccagaaugaacaaggcucuggguacgcggccgaucuuaagagcacccagaacgcuuuugacgagaucacgaauaaagucaacuccgugaucgagaagaugaauacacaguucaccgccguuggaaaagaguucaaccaccuggagaagagaauugaaaaucugaacaagaaaguggaugacggcuuucucgauaucuggaccuacaaugccgagcugcugguccuccuggaaaacgagcggacacuugacuaucaugauagcaaugugaagaaccuguacgagaaaguccgcucucagcucaagaacaaugcuaaagaaauugggaacggauguuucgaguuuuaucacaagugcgacaauaccuguauggaauccgugaagaacggcacauacgauuauccuaaauacagcgaggaagccaagcugaauagagaggagaucgacgggguuaaacuugaaucuacgcggauuuaucaaauccuggcgaucuacuccaccguggcuagcucccucguccuggugguuucucugggcgccauuagcuucuggaugugcuccaacggaucucuccagugccgcaucuguauuuga

SEQ ID NO: 192650 - RNA, 1701 nt, Artificial Sequence
  derived and/or modified sequence opt5 from hemagglutinin__InfluenzaA__AFN87949
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccuccgccgaucaacagucucuguaccagaacgcugacacauacguguucguggggaccagcagauauuccaagaaauuuaagccugagauugccauccggccgaaaguccgcgaucaggagggaagaaugaauuacuauuggacgcucguugaacccggcgacaagauuacauucgaggcuaccgggaaccugguggugccucgguacgccuuugcgauggaacgcaacgccggaagcggcaucauuaucucugauacacccguccaugacugcaauaccaccugucaaacaccuaaaggcgcuaucaacacgucccugcccuuccagaauauucacccgaucaccauugggaagugcccuaaguaugugaaaagcacaaagcucagacuggccaccggacuucggaacguucccucuauccagagccgcggccuguuuggggcuauugccggauucaucgagggcggguggacaggaaugguggacggcugguacggcuaucaucaccagaaugaacaaggguccggauacgccgcugaucucaaaucuacccagaacgcgaucgacaagauuacgaauaaagucaacagcgugaucgagaagaugaauacacaguuuaccgccguuggcaaggaguucaaccaccuggaaaagagaauugagaaucuuaacaagaaaguggaugacggguuccuggauaucuggaccuacaaugcugaacuccugguccugcucgagaacgaacggacacuggacuaucaugauuccaaugugaagaaccuuuacgagaaaguccgcagccagcugaagaacaaugccaaggagauuggaaacggcuguuuugaguucuaucacaaaugcgacaauaccuguauggagucugugaagaacgggacauacgauuauccuaaauacuccgaagaggccaagcucaauagagaagagaucgacggcguuaaacuggagagcacgcggaucuaucaaauucuugcuaucuacucuaccguggccuccagccugguccucgugguuucccugggagcgauuucuuuuuggaugugcagcaacggcucccugcagugccgcaucuguauuuga

SEQ ID NO: 192651 - RNA, 1701 nt, Artificial Sequence; identical to SEQ ID NO: 189964
  derived and/or modified sequence opt5 from hemagglutinin__InfluenzaA__AFN87951

SEQ ID NO: 192652 - RNA, 1701 nt, Artificial Sequence
  derived and/or modified sequence opt5 from hemagglutinin__InfluenzaA__AFN87953
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgccaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucguugagaccuccucuagcgacaacggcacgugcuauccgggggauuuuauugacuacgaagaacugcgggagcagcuuuccagcgugucuuccuucgaacgcuuugagaucuuccccaagaccagcucuuggccuaaucacgaucugaacaagggagucacagcugccuguccccaugcgggcgccaaauccuuuuauaagaaucucaucuggcuggugaaaaagggcaacagcuacccuaaacuuucuaaguccuauauuaaugacaaggggaaagaaguucuggugcucuggggaauccaccaccccagcaccuccgcugaucaacagucucuguaccagaacgccgacgcuuacgucuucgugggcacaagcagauauuccaagaaauuuaagccugagauugccauccggccgaaagugcgcgaucaggaggggagaaugaauuacuauuggacccuggucgaacccggagacaagauuacguucgaggcgacaggcaaccucguugugccucgguacgccuuugcuauggaacgcaacgccgggagcggaaucauuaucucugauacccccgugcaugacugcaauacaaccugucaaaccccuaaaggcgcuaucaacacaucccugcccuuccagaauauucacccgaucacgauuggcaagugcccuaaguaugucaaaagcaccaaacuuagacuggccacagggcuccggaacgugcccucuauccagagccgcggacuguuuggcgccauugcuggguucaucgagggaggcuggaccgggaugguugacggaugguacggcuaucaucaccagaaugaacaaggcuccggguacgcggccgaucuuaagucuacacagaacgcuaucgacgagauuaccaauaaggugaacagcgucaucgagaaaaugaauacgcaguuuacagccgugggaaaggaguucaaccaccuggagaagagaauugaaaaucucaacaaaaagguugaugacggcuuccuggauaucuggaccuacaaugccgagcugcucgugcugcuugaaaacgagcggacccuggacuaucaugauuccaaugucaaaaaccucuacgagaaggugcgcagccagcugaaaaacaaugcuaaggaaauugggaacggauguuuugaguucuaucacaagugcgacaauacauguauggaaucugucaaaaacggcaccuacgauuauccuaaguacuccgaggaagccaaacuuaauagagaggagaucgacggggugaagcuggaaagcacacggaucuaucaaauucucgcgaucuacucuacgguugcuuccagccuggugcuggucgugucccucggcgccauuucuuuuuggaugugcagcaacggaucccugcagugccgcaucuguauuuga

SEQ ID NO: 192653 - RNA, 1701 nt, Artificial Sequence
  derived and/or modified sequence opt5 from hemagglutinin__InfluenzaA__AFN87955
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccacagccgaucaacagucccuguaccagaacgcugacaccuacguguucguggggacgucuagauauagcaagaaauuuaagccugagauugccauccggccgaaaguccgcgaucaggagggaagaaugaauuacuauuggacacucguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucugcccuuccagaauauucacccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaucaccagaaugaacaagggagcggauacgccgcugaucucaaauccacgcagaacgcgaucgacgagauuacaaauaaggucaacucugugaucgagaaaaugaauacccaguuuaccgccguuggcaaggaguucaaccaccuggagaagagaauugaaaaucuuaacaaaaagguggaugacggguuccuggauaucuggacauacaaugcugagcuccugguccugcucgaaaacgagcggacccuggacuaucaugauagcaaugugaaaaaccuuuacgagaagguccgcucccagcugaaaaacaaugccaaggaaauuggaaacggcuguuuugaguucuaucacaagugcgacaauacauguauggaaagcgugaaaaacgggacguacgauuauccuaaguacucugaggaagccaaacucaauagagaggagaucgacggcguuaagcuggaauccacccggaucuaucaaauucuugcuaucuacagcacaguggccucuucccugguccucgugguuagccugggagcgauuuccuuuuggaugugcucuaacggcagccugcagugccgcaucuguauuuga

SEQ ID NO: 192654 - RNA, 1701 nt, Artificial Sequence
  derived and/or modified sequence opt5 from hemagglutinin__InfluenzaA__AFN87957
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucgacuacgaagaacugcgggagcagcuuagcuccgucagcucuuucgaacgcuuugagaucuuccccaagaccuccagcuggccuaaucacgaucccaacaagggagugacagccgcuuguccucaugccggcgcgaaaucuuuuuauaagaaucugauuuggcucguuaaaaagggcaacuccuaccccaaacugagcaccucuuauaucaaugacaaggggaaggaagugcuuguccuguggggcauucaccacccuuccacaagcgccgaucaacagucccucuaccagaacgcugacgccuacgcuuucgugggaaccucuagauauagcaaaaaguuuaaaccggagaucgccauucggcccaaggugcgcgaucaggaggggagaaugaauuacuauuggacgcuggucgaaccuggagacaaaaucacauucgaggcgaccggcaaccugguugugccccgguacgccuuugcuauggaacgcaacgccggguccggaauuaucaucagcgauacaucugugcaugacugcaauaccaccugucaaacaccuaagggcgcuauuaacacgucccuccccuuccagaauguccacccgaucaccauuggcaaaugcccuaaguauguuaagagcacaaaacugagacuugccaccgggcugcggaacgugcccucuauccagagccgcggacucuuuggcgccauugcuggguucaucgagggaggcuggacagggaugguggacggaugguacggcuaucaucaccagaaugaacaaggcuccggguacgcggccgaucugaagucuacccagaacgcuuuugacgagaucacgaauaaagucaacagcgugauugagaagaugaauacacaguucaccgccguuggaaaagaguucaaccaccuugagaagagaaucgaaaaucugaacaagaaaguggaugacggcuuucucgauauuuggaccuacaaugccgagcugcugguccuccuggaaaacgagcggacacuugacuaucaugauuccaaugugaagaaccuguacgagaaaguccgcagccagcucaagaacaaugcuaaagaaaucgggaacggauguuucgaguuuuaucacaagugcgacaauaaguguauggaaucugugaaaaacggcaccuacgauuauccuaaguacuccgaggaagccaaacugaauagagaggagauugacgggguuaaacuugaaagcacacggaucuaucaaauccuggcgauuuacucuacgguggcuuccagccucguccuggugguuucccugggcgccaucucuuucuggaugugcagcaacggaucccuccagugccgcauuuguaucuga

SEQ ID NO: 192655 - RNA, 1701 nt, Artificial Sequence
  derived and/or modified sequence opt5 from hemagglutinin__InfluenzaA__AFN87959
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauauuaaugacaagggaaaagaagugcugguccuuuggggcauccaccaccccagcaccuccgccgaucaacagucucuguaccagaacgcugacacauacguguucguggggaccagcagauauuccaagaaauuuaagccugagauugccauccggccgaaaguccgcgaucaggagggaagaaugaauuacuauuggacgcucguugaacccggcgacaagauuacauucgaggcuaccgggaaccugguggugccucgguacgccuuugcgauggaacgcaacgccggaagcggcaucauuaucucugauacacccguccaugacugcaauaccaccugucaaacaccuaaaggcgcuaucaacacgucccugcccuuccagaauauucacccgaucaccauugggaagugcccuaaguaugugaaaagcacaaagcucagacuggccaccggacuucggaacguucccucuauccagagccgcggccuguuuggggcuauugccggauucaucgagggcggguggacaggaaugguggacggcugguacggcuaucaucaccagaaugaacaaggguccggauacgccgcugaucucaaaucuacccagaacgcgaucgacaagauuacgaauaaagucaacagcgugaucgagaagaugaauacacaguuuaccgccguuggcaaggaguucaaccaccuggaaaagagaauugagaaucuuaacaagaaaguggaugacggguuccuggauaucuggaccuacaaugcugaacuccugguccugcucgagaacgaacggacacuggacuaucaugauuccaaugugaagaaccuuuacgagaaaguccgcaaccagcugaagaauaacgccaaggagauuggaaauggcuguuuugaguucuaucacaaaugcgacaacaccuguauggagagcgugaagaaugggacauacgauuauccuaaauacucugaagaggccaagcucaacagagaagagaucgacggcguuaaacuggaguccacgcggaucuaucaaauucuugcuaucuacagcaccguggccucuucccugguccucgugguuagccugggagcgauuuccuuuuggaugugcucuaauggcagccugcagugccgcaucuguauuuga

SEQ ID NO: 192656 - RNA, 1701 nt, Artificial Sequence; identical to SEQ ID NO: 186178
  derived and/or modified sequence opt5 from hemagglutinin__InfluenzaA__AFN87961

SEQ ID NO: 192657 - RNA, 1698 nt, Artificial Sequence
  derived and/or modified sequence opt5 from hemagglutinin__InfluenzaA__AFO64802
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccguuaaaaacggccucuaucccaaucugucuaaguccuacgugaacaauaaagggaaggaaguccuggugcucuggggagugcaucacccuagcaacaucagagaucagcgggccauuuaccacacagagaacgcuuaugucuccguugugucuagccauuacucccgcagauucaccccggaaaucgccaaacggcccaaggugcgcgaccaggagggcagaauuaauuauuacuggacgcugcuugaaccuggggauacaaucauuuuugaggcgaacggaaaucugaucgcccccugguaugcuuucgcccucagccggggcuuugggucuggaauuaucaccuccaacgcuccuauggacgagugugaugccaagugccagacaccccaaggcgcgaucaauagcucucugccguuccagaacguccacccugugaccauuggcgaaugucccaaauacguucgcagcgccaaacuuagaauggugaccgggcugcggaauaucccuuccauucagucucgcggacucuuuggcgcuaucgccggguucauugagggaggcuggacagggaugaucgacggaugguauggcuaccaucaccagaacgaacaaggcagcggguacgcugccgaucagaaguccacgcagaaugccaucaacggaauuaccaauaaggucaacagcgugaucgagaaaaugaauacacaguuuaccgcuguuggcaaggaguucaacaaacuggaaagacggauggagaaucugaacaagaagguggacgauggguuccucgacauuuggacauauaacgcggaacugcuuguccugcucgagaaugaacgcacccuggacuuucacgauucuaacgugaaaaaucuuuacgagaaggucaaaucccaacugaagaacaaugccaaagaaaucggaaacggcugcuucgaguuuuaucauaaguguaauaacgagugcauggaaagcgugaagaaugggacguacgacuaucccaaauacucugaggaauccaagcucaacagagagaaaauugauggcguuaagcuggagagcaugggaguguaucagauccuggcuaucuacuccacagucgccucuagccucgugcugcuuguuucccugggcgccauuucuuucuggaugugcagcaaugggucccuccagugucggaucugcauuuga

SEQ ID NO: 192658 - RNA, 1701 nt, Artificial Sequence
  derived and/or modified sequence opt5 from hemagglutinin__InfluenzaA__AFO64813
augaaggccaagcugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaaaggagugacagcuucuugcucccacaagggcagaagcucuuucuaucggaaccugcucuggcugaccgagaaaaauggcuccuacccuaaccuuagcaaguccuaugucaauaacaaagaaaaggaggugcugguucucuggggagugcaucaccccucuaauauccgcgaccagagagccauuuaccacacagaaaacgcguacgucagcgugguguccagccauuauaaccggcgcuuuaccccugagaucgccaagagaccgaaaguccgggaucaggaagggcgcauuaauuacuauuggacgcugcuggagcccggcgacacaaucauuuucgaggcuaacgggaaucucaucgccccuugguacgcuuuugcccugucuagaggauucggcuccgggauuaucaccagcaacgcgucuauggaugaaugugacgccaagugccagacaccccaaggagcuaucaauagcucccuuccuuuucagaacguucaccccgugaccauuggcgaguguccgaaauaugugcggucuaccaagcugcgcauggucacaggccucagaaauaucccuagcauucagucccgggggcuguucggagccaucgcuggcuuuauugaagggggauggacgggcaugaucgaugggugguacggauaucaucaccagaacgagcaaggcagcggcuacgccgccgaccagaaaucuacccagaaugcuaucaacgggauuacaaauaaggugaacuccguuaucgaaaagaugaauacccaguucacagcggugggaaaggaguucaacaaacuugagcgcagaauggaaaaucugaacaaaaaggucgaugacggcuuucucgacauuuggaccuacaacgccgagcugcuggugcuccuggaaaaugagcggacgcuugauuuccacgacagcaacguuaaaaaucuguaugaaaaggugaaaucucaacucaagaacaaugcuaaggagaucgggaacggaugcuuugaguucuaccauaaauguaauaacgaaugcauggaguccgucaagaauggcacauaugauuaccccaaauauagcgaagaguccaagcugaacagagagaaaauugacggggugaaacuugaaucuaugggcgucuaccagauccuggccaucuauagcaccguggccuccucucucguucugcuggugagccucggagcuauuuccuuuuggaugugcagcaauggcucucugcagugucgcaucugcauuuga

SEQ ID NO: 192659 - RNA, 1701 nt, Artificial Sequence
  derived and/or modified sequence opt5 from hemagglutinin__InfluenzaA__AFO64824
augaaggccauccugcucgugcugcuuugcgcuuucaccgccacagacgcggauacgauuuguaucggcuaccacgcuaacaauagcaccgacacagucgauaccguucuggagaaaaacgugacagugacccauuccgucaaucuccuggaagacucucacaacgggaaacuuugcagacugaaaggaauugccccgcuccagcugggcaauuguagcaucgccggguggauucugggaaacccugagugcgaaucccucuuuucuaagaaaagcugguccuauaucgcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaagggagugacagcuucuugcucccacaaaggcagaagcucuuucuaucggaaccugcucuggcugaccgagaagaauggccuuuacccuaaccuguccaaaagcuaugucaauaacaaggaaaaagaggugcucguucuguggggagugcaucaccccuccaauauuggggaccagcgcgccaucuaccacacagaaaacgcguacgucucuguggugagcucccauuauaacagacgguuuaccccugagauugccaagcgcccgaaggucagaggccaggaagggcggaucaauuacuauuggacgcugcucgagcccggagauacaauuaucuucgaggcuaacggcaaucugauugccccuugguacgcuuuugcccuuagccgcggguucggaucuggcaucaucaccuccaacgcgagcauggacgaaugugaugccaaaugccagacaccccaaggcgcuauuaauucuagccugccuuuucagaacguucaccccgugaccaucggggaguguccgaaguaugugagauccaccaaacucaagauggucacaggacugcggaauauuccuucuauccagagccgcggccuuuucggggccauugcuggauuuaucgaaggcggguggacgggaaugaucgacggcugguacggcuaucaucaccagaacgagcaaggguccggauacgccgccgaucagaaaagcacccagaaugcuauuaacggcaucacaaauaaggugaacucuguuauugaaaagaugaauacccaguucacagcgguggggaaggaguucaacaagcuggagaaaagaauggaaaaucucaacaagaaagucgacgauggauuucuggacaucuggaccuacaacgccgagcugcucgugcugcuugaaaaugagcggacgcuggacuuccacgauuccaacguuaagaaucucuaugaaaaagugaagaaccaacugaagaauaacgcuaaagagauuggcaaugggugcuuugaguucuaccauaaguguaacaaugaaugcauggagagcgucaaaaacggcacauaugacuaccccaaguauucugaagaguccaaacuuaaucgcgagaagaucgauggagugaagcuggaaagcaugggcgucuaccagauccucgccauuuauuccaccguggccucuagccugguucugcucgugucccugggggcuaucucuuuuuggaugugcagcaacggaucccuucaguguagaauuugcaucuga

SEQ ID NO: 192660 - RNA, 1701 nt, Artificial Sequence
  derived and/or modified sequence opt5 from hemagglutinin__InfluenzaA__AFO64835
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccugagugcgaaucccucuuuucuaaagagagcugguccuacaucgccgaaacaccggaccccgagaauggcaccuguuauccuggguacuucgccgauuaugaggaacugcgggagcaacuuucuagcguuuccagcuuugaacgcuucgagauuuuucccaaggagucuuccuggccuaaccauacggugaccaagggagucacagcuagcugcucucacaauggcaaauccagcuucuacagaaaccugcucuggcugaccaagaaaaauggccuuuaucccaaccugucuaaguccuacgugaauaacaaagaaaaggagguucucgugcuguggggaguccaucacccuagcaauaucggggaacagcgggccaucuaccacacagagaacgcguauguguccguggucucuagccauuacucccgcagauuuaccccggaaauugccaagcggcccaaaguucgcgaccaggagggcagaaucaacuauuacuggacgcugcucgagccuggggauacaauuaucuucgaagcuaauggaaaccugauugcccccugguaugcuuuugcccuuagccggggcuucgggucuggaaucauuaccuccaaugcgagcauggacgagugugaugccaagugccagacaccucaaggcgcuaucaacucuagccugcccuuucagaaugugcacccggugaccaucggcgaauguccuaaauacguccgcuccaccaagcucagaauggugacagggcugcggaacauucccucuauccagagccgcggacuuuucggcgccauugcuggguuuaucgagggaggcuggacggggaugauugacggaugguauggcuaccaucaccagaaugaacaaggcuccggguacgccgccgaucagaaaagcacccagaacgcuaucaauggaaucacaaacaagguuaauucugugauugagaaaaugaacacccaguucacagcggucggcaaggaguucaauaagcuggaaagacggauggagaaccucaauaaaaagguggacgauggguuucuggacaucuggaccuauaacgccgaacugcucguucugcuugagaacgaacgcacgcuggacuuccacgauuccaaugugaaaaaccucuacgagaaggucaaaaaucaacugaagaacaaugcuaaggagauuggaaacggcugcuuugaguucuaucauaaauguaauaacgaaugcauggaaagcgugaagaaugggacauacgacuauccuaaauacucugaggaguccaaacuuaacagagaaaagaucgauggcgucaagcuggagagcaugggaguguaucagauucucgccaucuacuccaccguugccucuagccuggugcugcucgucucccugggcgcuaucucuuuuuggaugugcagcaaugggucccuucagugucggauuugcaucuga

SEQ ID NO: 192661 - RNA, 1701 nt, Artificial Sequence
  derived and/or modified sequence opt5 from hemagglutinin__InfluenzaA__AFO64846
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccugagugcgaaucccucuuuacaaaagagucuuggagcuacaucgccgaaaccccgaaucccgagaacggcacguguuauccuggguacuucgccgacuaugaggaacugcgggagcaacuuuccucuguuagcuccuuugaacgcuucgagauuuuucccaaggagagcucuuggccuaaucauaccgugacaaagggagucaccgcuuccugcagccacaacggcaaaucuuccuucuacagaaaucugcucuggcugacagaaaagaacggccuuuaucccaaucugagcaaaucuuacgugaacaauaaggagaaagaaguucucgugcuguggggaguccaucacccuuccaacaugggggaucagcgggccaucuaccacaccgagaacgcguaugugagcguggucuccucucauuacagccgcagauuuacgccggaaaucgccaagcggcccaagguucgcggccaggaggggagaauuaauuauuacuggacacugcucgagccuggagacaccaucauuuucgaagcuaacggcaaucugaucgcuccccgguaugccuuugcccuuucccgcggguucggaagcggcauuaucacaucuaacgcguccauggaugagugugacgccaaaugccagaccccucaaggcgcuauuaauagcucucugcccuuucagaacgugcacccggugaccaucggggaauguccuaaguacgucagaagcacaaaacuccggauggugacgggacugcgcaauauccccuccauucagucuagaggccuuuucggggccaucgcuggauuuauugagggcggguggaccggaaugaucgauggcugguauggcuaccaucaccagaacgaacaagggagcggauacgccgccgaccagaaguccacacagaaugcuauuaacggcaucaccaauaaaguuaacagcgugaucgagaagaugaauacacaguucaccgcggucgggaaagaguucaacaagcuggaacggcgcauggagaaucucaacaagaaaguggaugacggauuucuggauauuuggacguauaacgccgaacugcucguucugcuugagaaugaaagaacacuggacuuccacgacucuaacgugaagaaucucuacgagaaagucaagucccaacugaaaaacaaugcuaaggagaucggcaacgggugcuuugaguucuaucauaaguguaauaacgaaugcauggaaagcgugaaaaauggcaccuacgauuauccuaaguacucugaggaguccaaacuuaaccgggaaaagauugacggagucaaacuggagagcaugggcguguaucagauccucgccauuuacuccaccguugccucuagccuggugcugcucgucucccugggggcuaucucuuuuuggaugugcagcaauggaucccuucaguguagaaucugcauuuga

SEQ ID NO: 192662 - RNA, 1701 nt, Artificial Sequence
  derived and/or modified sequence opt5 from hemagglutinin__InfluenzaA__AFO64857
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagagaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucggggccaggaggggcgcauuaauuauuacuggacacugcucgagccuggagacaccaucauuuucgaagcuaacggcaaucugaucgcccccugguaugcuuuugcccuuagcagaggguucggaucuggcauuaucacauccaccgcgagcaugggcgagugugaugccaagugccagaccccucaaggggcuauuaacucuagccugcccuuucagaaugugcacccggugacaaucggagaauguccuaaauacguccgguccacgaagcuccgcauggugaccggccugagaaacauccccucuauucagagccgggggcuuuucggagccaucgcuggcuuuauugaagggggauggacaggcaugaucgacggcugguauggguaccaucaccagaaugaacaaggauccggcuacgccgccgaucagaaaagcacccagaacgcuauugacgggaucacaaauaagguuaacucugugaucgagaaaaugaauacccaguucacggcggucggaaaggaguucaacaagcuggaacgcagaauggagaaucucaacaaaaagguggaugacggcuuucuggauauuuggacauauaaugccgaacugcucguucugcuugagaacgggcggacccuggacuuccacgacuccaacgugaaaaaucucuacgaaaaggucaaaaaccaacugaagaauaacgcuaaggagaucggcaauggaugcuuugaguucuaucauaaauguaacaaugaaugcauggagagcgugaagaacggcaccuacgauuauccuaaauacucugaagaguccaaacuuaaucgcgagaagauugacggggucaagcuggaaagcaugggaguguaucagauccucgccauuuacuccacaguugccucuagccuggugcugcucgucucccugggcgcuaucucuuuuuggaugugcagcaacgggucccuucaguguagaaucugcauuuga

SEQ ID NO: 192663 - RNA, 1701 nt, Artificial Sequence
  derived and/or modified sequence opt5 from hemagglutinin__InfluenzaA__AFO64868
augaaggugaaacugcucguccugcuuugcgccuucaccgcuacauacgccgacacgaucuguauuggcuaucacgcgaacaauagcaccgauacaguugacaccgugcuggagaagaacgugacagucacccauuccgugaaucuccuggaagauucucacaacgggaaacuuugcagacugaagggaacagcuccccuccagcugggcaauuguagcguugccggguggauccugggaaacccugagugcgaaucccucuuuucuaaagagagcugguccuacauugccgaaaccccgaaucccgagaacggcacguguuauccugggugcuucgcugacuacgaggaacugcgggagcaacuuucuagcguguccagcuuugaacgcuucgagaucuuucccaaggagucuuccuggccuaaucauaccgucacaaagggagugaccgccagcuguucucacaacggcaaauccagcuucuauaagaaucugcucuggcugacagaaaagaacggccuuuaccccaaucugucuaaguccuauguuaacaauaaagagaaggaagugcucguccuguggggagugcaucacccuagcaacauuagagaucagcgggcuaucuaccacaccgagaacgccuacguguccgucguuucuagccauuauucccgcagauuuacgccggaaaucgcgaagcggcccaaagugcgcgggcaggagggcagaauuaauuacuauuggacacugcucgagccuggggacaccaucauuuucgaagccaacggaaaucugaucgcucccugguacgccuuugcucuuagccggggcuucgggucuggaauuaucacauccaacgccagcaugggcgagugcgaugcgaagugucagaccccucaaggcgccauuaauucuagccugcccuuucagaacgugcacccggucaccaucggggaaugcccuaaauaugugcgcuccacaaagcucagaaugguuacgggacugcggaauauccccucuauucagagccgcggccuuuucggggcuaucgccggauuuauugagggcggguggaccggaaugaucgacggcugguacggcuaucaucaccagaacgaacaaggguccggauacgcugccgaucagaaaagcacacagaaugccauugacggcaucaccaacaaggucaauucugugaucgagaaaaugaacacacaguucaccgcuguggggaaggaguucaauaagcuggaaagacggauggagaaccucaauaaaaagguugaugacggauuucuggauauuuggacguacaacgcggaacugcucgugcugcuugagaacgaacgcacacuggacuuccacgacuccaaugucaaaaaccucuaugagaaggugaaaaaucaacugaagaacaaugccaaggagaucggcaacggguguuuugaguucuaccauaaaugcaauaacgaaugcauggaaagcgucaagaauggcaccuaugauuacccuaaauauucugaggaguccaaacuuaacagagagaaaauugacggagugaagcuggaaagcaugggcguuuaccagauccucgcuauuuauuccaccguggccucuagccugguccugcucgugucccugggggccaucucuuuuuggauguguagcaauggaucccuucagugccggaucuguauuuga

SEQ ID NO: 192664 - RNA, 1698 nt, Artificial Sequence
  derived and/or modified sequence opt5 from hemagglutinin__InfluenzaA__AFO64879
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucuuuaaagagucuuggagcuacauuguugaaaccccgaaucccgagaacggcacguguuauccuggguacuucgccgacuaugaggaacuuagagagcaacuguccucugugagcuccuuugaacgguucgagaucuuucccaaggagagcucuuggccuaaucauaccgucacaggaguguccgcuagcugcucucacaacggcaaguccagcuucuaccgcaaucuccuguggcuuaccgagaaaaacggccuguaucccaaucucucuaaguccuacguuaacaauaaagaaaaggaagugcugguccuguggggagugcaucacccuagcaacaucagagaucagcgggccauuuaccacacagagaacgcuuauguguccgucguuucuagccauuacucccgcagauuuaccccggaaaucgccaaacggcccaaggugcgcgggcaggagggcagaauuaauuauuacuggacgcuccuggagccuggggacacaaucauuuucgaagcgaacggaaaucuuaucgcccccugguaugcuuuugcccugagccggggcuucgggucuggaauuaucaccuccaacgcuccuauggaugagugugacgccaagugccagacaccccaaggcgcgaucaauagcucucucccguuucagaacgugcacccugucaccauuggcgaaugucccaaauacgugcgcagcgccaagcugagaaugguuaccgggcuucggaauaucccuuccauucagucucgcggacuguucggcgcuaucgccggguuuauugagggaggcuggacagggaugaucgauggaugguauggcuaccaucaccagaacgaacaaggcagcggguacgcugccgaccagaaauccacgcagaaugccaucaacggaauuaccaauaaggugaacagcgucaucgagaaaaugaauacacaguucaccgcugugggcaaggaguucaacaaacucgaaagacggauggagaaucugaacaagaagguugaugacggguuucuggauauuuggacauauaacgcggaacuccuggugcuucuggagaaugaacgcacccucgacuuccacgacucuaacgucaaaaaucuguacgagaaggugaaaucccaacuuaagaacaaugccaaagagaucggaaacggcugcuuugaguucuaucauaaguguaauaacgaaugcauggaaagcgucaagaaugggacguacgauuaucccaaauacucugaggaguccaagcugaacagagagaaaauugacggcgugaagcucgaaagcaugggaguuuaucagauccuggcuaucuacuccacaguggccucuagccugguccuccuggugucccuuggcgccauuucuuuuuggaugugcagcaaugggucccugcagugucggaucugcauuuga

SEQ ID NO: 192665 - RNA, 1698 nt, Artificial Sequence
  derived and/or modified sequence opt5 from hemagglutinin__InfluenzaA__AFO64890
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucagagaucagcgggccauuuaccacacagagaacgcuuaugugucugucguuagcucccauuacagccgcagauucaccccggaaaucgccaaacggcccaaggugcgcgggcaggagggcagaauuaauuauuacuggacgcuccuggagccuggggacacaaucauuuuugaagcgaacggaaaucuuaucgcccccugguaugcuuucgcccugucucggggcuuuggguccggaauuaucaccagcaacgcuccuauggaugagugugacgugaagugccagacaccccaaggcgccaucaauucuagccucccguuccagaacguccacccugugaccauuggcgaaugucccaaauacguucgcuccgcgaagcugagaauggugaccgggcuucggaauaucccuucuauucagagccgcggacuguuuggcgccaucgcuggguucauugagggaggcuggacagggaugaucgauggaugguauggcuaccaucaccagaacgaacaaggcuccggguacgccgcugaccagaaaagcacgcagaaugccaucaacggaauuaccaauaaggucaacucugugaucgagaaaaugaauacacaguuuaccgccguuggcaaggaguucaacaaacucgaaagacggauggagaaucugaacaagaagguggaugacggguuccuggauauuuggacauauaacgcugaacuccugguccuucuggagaaugaacgcacccucgacuuucacgacuccaacgugaaaaaucuguacgagaaggucaaaagccaacuuaagaacaaugcgaaagagaucggaaacggcugcuucgaauuuuaucauaaguguaauaacgagugcauggaaucugugaagaaugggacguacgauuaucccaaauacuccgaggagagcaagcugaacagagagaaaauugacggcguuaagcucgaauccaugggaguguaucagauccuggccaucuacucuacagucgcuagcucccuggugcuccugguuucucuuggcgccauuagcuucuggaugugcuccaaugggagccugcagugucggaucugcauuuga

SEQ ID NO: 192666 - RNA, 1701 nt, Artificial Sequence
  derived and/or modified sequence opt5 from hemagglutinin__InfluenzaA__AFO64901
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaagagagcugguccuacaucgccgaaaccccgaaucccgagaacggcacguguuauccuggguacuucgccgacuaugaggaacugcgggagcaacuuucuagcguguccagcuuugaacgcuucgagauuuuucccaaggagucuuccuggccuaaucauaccguuacaaagggagugaccgcuagcugcucucacaacggcaaauccagcuucuacaagaaucugcucuggcugacagaaaagaacggccuuuaucccaaucugucuaaguccuacgucaacaauaaaaagaaggaggugcucguucuguggggagugcaucacccuagcaacaucggggaucagagagccaucuaccacaccgaaaacgcguaugucuccguggugucuagccauuacucccggcgcuuuacgccggagauugccaaaagacccaagguccggaaucaggaaggccgcaucaacuauuacuggacacugcucgagccuggggacaccauuaucuucgaggcuaauggaaaccugauugcccccugguaugcuuuugcccuuagcagaggcuucgaaucugggaucauuacauccaaugcgagcaugggagagugugaugccaaaugccagaccccucaaggcgcuaucaacucuagccugcccuuucagaauguucacccggugaccaucggcgaauguccuaaguacgugcgguccacaaaacuccgcauggucacggggcugagaaacauucccucuauccagagccggggacuuuucggcgccauugcuggguuuaucgagggaggcuggaccgggaugauugacggaugguauggcuaccaucaccagaaugaacaaggcuccggguacgccgccgaucaaaagagcacacagaacgcuaucaauggaaucaccaacaaaguuaauucuauuaucgagaagaugaacacacaguucaccgcggugggcaaggaguucaauaaacuggaacgcagaauggagaaccucaacaagaaaguggacgauggguuucuggacauuuggacguauaaugccgaacugcucguccugcuugagaacgaacggacacuggauuuccacgacuccaaugugaagaaccucuacgagaaaguuaagaaucagcugaagaacaaugcuaaagagaucggaaacggcugcuuugaguucuaucauaaguguaauaacgaaugcauggaaagcgugaaaaaugggaccuacgacuauccuaaguacucuaaagaguccaaacuuaaccgcgagaagauugauggcgucaaacuggaaagcaugggaguguaucagauccucgccaucuacuccaccgucgccucuagccuggugcugcucguuucccugggcgcuauuucuuuuuggaugugcagcaaugggucccuucaguguagaaucugcauuuga

SEQ ID NO: 192667 - RNA, 1698 nt, Artificial Sequence
  derived and/or modified sequence opt5 from hemagglutinin__InfluenzaA__AFO65016
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccaaaaagaacggccuguaucccaaucucuccaaaagcuacguuaacaauaaggaaaaagaggugcugguccuguggggagugcaucacccuuccaacaucggggaucagagaacaauuuaccacaccgaaaacgccuaugugucugucguuagcucccauuacagccggcgcuucacgccggagaucgcuaagagacccaaggugcgggaccaggaaggccgcauuaauuauuacuggacacuccuggagccuggggauaccaucauuuuugaggccaacggaaaucuuaucgcgcccugguaugccuucgcucugucuagaggcuuuggguccggaauuaucacaagcaacgccccuauggacgaaugugaugcuaaaugccagacaccccaaggcgccaucaauucuagccucccguuccagaacgugcacccuauuaccaucggcgagugucccaaguacguccgguccgcgaaacugcgcauggugaccgggcuuagaaauauuccuucuauccagagccggggacuguuuggcgccauugcuggguucaucgaaggaggcuggacggggaugaucgacggaugguauggcuaccaucaccagaacgagcaaggcuccggguacgccgcugaucaaaagagcacccagaaugccauuaacggaaucacaaauaaaguuaacucugugauugaaaagaugaauacccaguuuacagccgucggcaaagaguucaacaaucucgagcgcagaauggaaaaccugaacaagaagguggacgauggguuccuggacaucuggaccuauaaugcugagcuccugguucuucuggaaaacgagcggacgcucgacuuucacgauuccaaugugaaaaaccuguacgaaaaggucaaaagccagcuuaagaauaacgcgaaagagauuggaaauggcugcuucgaguuuuaucauaaguguaacaaugaaugcauggagucugugaagaacgggacauacgacuaucccaaauacuccgaagagagcaagcugaaucgcgagaaaaucgauggcgucaagcucgaauccaugggaguguaucagauccuggccauuuacucuaccguugcuagcucccuggugcuccuggucucucuuggcgccaucagcuucuggaugugcuccaacgggagccugcaguguagaauuugcaucuga

SEQ ID NO: 192668 - RNA, 1698 nt, Artificial Sequence; identical to SEQ ID NO: 185139
  derived and/or modified sequence opt5 from hemagglutinin__InfluenzaA__AFO65027

SEQ ID NO: 192669 - RNA, 1698 nt, Artificial Sequence
  derived and/or modified sequence opt5 from hemagglutinin__InfluenzaA__AFO65038
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuauguccuacguuaacaauaaggaaaaagaggugcugguccucuggggagugcaucacccuccgaacaucggcaaccagagagcccuguaccacacagaaaaugcuuaugugagcgucguuuccucucauuacagccggcgcuucacccccgagauugccaagagaccuaaagugcgggaucaggaagggcgcaucaacuauuacuggacgcuucuggagcccggagacacaauuaucuuugaggcgaauggcaaccucauugccccuugguaugcuuucgcccuguccagaggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaguacgugcggucugccaaacugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccaaaagagcacgcagaacgccauuaauggcaucaccaacaaagucaauuccgugaucgaaaagaugaacacacaguuuaccgcuguugggaaagaguucaauaagcuggagcgcagaauggaaaaccucaacaaaaagguggaugacggauuccuggauauuuggacauauaaugcggagcuucugguccuccuggaaaacgagcggacccuugacuuucacgacagcaaugugaagaaccuguacgaaaaagucaagucucagcucaaaaauaacgccaaggagaucggcaaugggugcuucgaguuuuaucauaaauguaacaaugaaugcauggaguccgugaagaacggcacguacgauuaucccaaguacagcgaagagucuaaacugaaucgcgagaagauugacggaguuaaacuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 192670 - RNA, 1698 nt, Artificial Sequence
  derived and/or modified sequence opt5 from hemagglutinin__InfluenzaA__AFO66136
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuagauaugcuuucgcccugucccggggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcgcucugccaagcugagaaugguuaccggacuccggaacauucccagcauccagucccgcggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagagacggauggaaaaccucaacaagaagguggaugacggauuccuggauauuuggacauauaaugcggagcuucugguccuccuggaaaacgagcgcacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaauagagagaaaauugacggaguuaagcuggaauccaugggcguguaucagauccucgcuauuuacagcacagucgccuccucucuggugcuucugguuagccucggggccaucuccuucuggaugugcucuaacggaagccugcagugucggaucugcauuuga

SEQ ID NO: 192671 - RNA, 1701 nt, Artificial Sequence
  derived and/or modified sequence opt5 from hemagglutinin__InfluenzaA__AFO66147
augaaggccaaacugcucgugcugcuuugcgcuuucaccacaacguacgccgacaccaucuguauuggcuaucacgcgaacaauagcacagauaccgucgacacaguucuggagaagaacgugaccgugacacauuccgucaaucuccuggaagauucucacaacgggaaacuuugcagacugaagggaaccgcuccccuccagcugggcaauuguagcaucgccggguggauucugggaaacccugagugcgaaucccucuuuucuaaagagagcugguccuacaucgccgaaacgccgaaucccaagaacggcaccuguuauccuggguacuucgcugacuaugaggagcugcgggaacaacuuucuagcguguccagcuuugagcgcuucgaaauuuuucccaaggauucuuccuggccuaaucauacaguuaccaaaggagugacagccagcugcucucacaacggcaaguccagcuucuacaaaaaucugcucuggcugaccggcaagaacgggcuuuaucccaaucugucuaaauccuacgucaacaagaagggaaaagaggugcucguucuguggggcgugcaucacccuagcaauaugggggaccagagagcuaucuaccacaaggagaacgccuaugucuccgugcugucuagccauuacucccggcgcuuuacgccggaaaucgcgaaaagacccaaggugcgggaucaggagggacgcauuaacuauuacuggacacuccuggaaccuggcgacaccaucauuuucgaggccaaugggaaccuuaucgcucccugguaugccuuugcucugagcagaggauucggcucuggcauuaucauuuccaaugccagcaugggggaaugugaugcgaaaugccagacaccucaaggagccaucaacucuagccuccccuuucagaauguccacccgguuaccaucggcgaguguccuaaguacgugcgguccaccaaacugcgcauggugacagggcuuagaaacguccccucuauucagagccggggacuguucggcgcuaucgccggguuuauugagggaggcuggacgggcaugaucgacgggugguauggauaccaucaccagaaugaacaaggcuccggguacgcugccgaucagaagucuacccagaacgccauuaauggaaucacaaacaaggugaauagcaucauugagaaaaugaacacccaguucacagcuguuggcaaggaguucaauaaacucgaacgcagaauggaaaaccugaauaagaaaguggacgauggguuucuggacaucuggaccuauaacgcggagcuccugguccuucuggagaacgaacggacgcucgacuuccacgauuccaaugugaagaaccuguacgagaagguuaaaaaucaacuuaagaacaaugccaaagaaauuggcaacggaugcuuugaguucuaucauaaguguaauaacgaaugcauggagagcgugaaaaauggcacauacgacuauccuaaguacucuaaggaguccaaacugaaccgcgaaaagaucgauggggucaaacucgagagcaugggaguguaucagauucuggcuaucuacuccaccgucgccucuagccuggugcuccugguuucccuuggcgccaucucuuuuuggaugugcagcaaugggucccugcaguguagaauuugcaucuga

SEQ ID NO: 192672 - RNA, 1698 nt, Artificial Sequence
  derived and/or modified sequence opt5 from hemagglutinin__InfluenzaA__AFO66158
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaaggcucuuggagcuacauuguugagaccccgaaucccgaaaacgggacguguuauccuggauacuuugccgacuaugaggagcugagagaacaacucuccucugugagcuccuucgagcgguuugaaaucuuccccaagggcagcucuuggccuaaucauaccgucacaggcguguccgcuagcugcucucacaacgggaaguccagcuuuuaccgcaaucugcuuuggcugaccgggaaaaacggccucuaucccaaucugucuauguccuacguuaacaauaaggagaaagaggugcugguccucuggggagugcaucacccuccgaacaucggaaaccagagagcccuguaccacacagaaaaugcuuaugugagcgucguuuccucucauuacagccggcgcuucacccccgagauugccaagagaccuaaagugcgggaucaggaaggccgcaucaacuauuacuggacgcuucuggagcccggggacacaauuaucuuugaagcgaauggaaaccucauugccccuugguaugcuuucgcccuguccagaggcuuuggcagcgggaucauuaccucuaaugcucccaugggagagugugaugccaagugccagacaccgcaaggcgcgaucaacuccagccuuccuuuccagaaugugcaccccgucaccaucggggaguguccuaaguacgugcggucugccaaacugcgcaugguuaccggacucagaaacauucccagcauccagucccggggccuguuuggggcuauugccggauucaucgaaggcggcuggacagggaugguggacggaugguauggcuaccaucaccagaaugagcaagggucuggauacgcugccgaucaaaagagcacgcagaacgccauuaauggcaucaccaacaaagucaauuccgugaucgaaaagaugaacacacaguuuaccgcuguugggaaagaguucaauaagcuggaacgcagaauggagaaccucaacaaaaagguggacgauggcuuccuggacauuuggacauauaaugcggagcuucugguccuccuggaaaacgagcggacccuugauuuucacgacagcaaugugaagaaccuguacgaaaaagucaagucucagcucaaaaauaacgccaaggagaucggaaauggcugcuucgaauuuuaucauaaauguaacaaugagugcauggaguccgugaagaacgggacguacgacuaucccaaguacagcgaagagucuaaacugaaucgcgaaaagauugauggaguuaaacuggaguccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 192673 - RNA, 1698 nt, Artificial Sequence
  derived and/or modified sequence opt5 from hemagglutinin__InfluenzaA__AFO66169
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccuccaauccggagaacggcacguguuaucccggguacuuuaccgacuaugaggaacugagagagcaacucucuagcgucuccagcuucgaacgguuugagaucuucccuaaggagucuuccuggcccaaucauacagugaccggaguuagcgccucuugcucccacaacggcaagagcucuuuuuacaaaaaucugcuuuggcugacaggcaagaacgggcucuauccuaaucuguccaaaagcuacgccaacaauaaggaaaaagaggugcugguccucuggggagugcaucaucccccuaacaucggcgaucagcgcgcucuguaccacaccgaaaacgccuauguguccgucguuucuagccacuacuccagacgguucacgccggagauugcuaagcgccccaaggugagagaccaggaagggcggaucaauuauuacuggacacuucuggagccuggagauaccauuaucuuugaggccaacggcaaucucauugcgccccgcuaugccuucgcucugagcagaggguuuggaucuggcaucauuacauccaacgccccuauggacgaaugugaugcuaaaugccagacaccccacggcgccaucaauagcucucuuccguuccaaaacgugcauccugucaccaucggggagugucccaaguacgugcggagcgcgaaacugcgcaugguuaccggacucagaaauauuccuuccauccagucucggggccuguuuggggccauugcuggauucaucgaaggcggguggacgggaaugguggacggcugguauggcuaccaccaccagaacgagcaggggagcggauacgccgcugaucaaaaguccacccagaaugccauuaacggcaucacaaauaaagucaacagcgugaucgaaaagaugaauacccaguuuacagccguugggaaagaguucaacaagcuggagcgcagaauggaaaaucucaacaagaaaguggacgauggauucauugacaucuggaccuauaacgcugagcugcuuguccugcucgaaaaugagcggacgcuggacuuucaugauucuaacgugaagaaucuuuacgaaaaagucaagucccagcugaaaaacaaugcgaaggagauuggcaacgggugcuucgaguuuuaucacaaguguaaugacgaaugcauggagagcgugaaaaacggcacauacgauuaucccaaguacucugaagaguccaaacucaaucgcgagaagaucgacggaguuaaacuggaaagcaugggcguguaucaaauucuggccaucuacuccaccgucgcuucuagccucgugcugcuuguuucccugggggccaucucuuucuggaugugcagcaacggaucccuccaguguagaauuugcaucuga

SEQ ID NO: 192674 - RNA, 1698 nt, Artificial Sequence
  derived and/or modified sequence opt5 from hemagglutinin__InfluenzaA__AFO66180
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcggaaucaggagggacgcaucaacuauuacuggacgcuucuggaacccggcgacacaauuaucuuugaggcgaaugggaaccucauugccccuugguaugcuuucgcccuguccagaggauuuggcagcggcaucauuaccucuaaugcucccaugggggagugugaugccaagugccagacaccgcaaggagcgaucaacuccagccuuccuuuccagaaugugcaccccgucaccaucggcgaauguccuaaguacgugcggucugccaaacugcgcaugguuaccgggcucagaaacauucccagcauccagucccggggacuguuuggcgcuauugccggguucaucgagggaggcuggacaggcaugguggacgggugguauggauaccaucaccagaaugaacaaggcucuggguacgcugccgaucaaaagagcacgcagaacgccauuaauggaaucaccaacaaagucaauuccgugaucgagaagaugaacacacaguuuaccgcuguuggcaaagaguucaauaagcuggaacgcagaauggagaaccucaacaaaaagguggacgauggguuccuggacauuuggacauauaaugcggaacuucugguccuccuggagaacgaacggacccuugauuuucacgacagcaaugugaagaaccuguacgagaaagucaagucucagcucaaaaauaacgccaaggaaaucggcaauggaugcuucgaguuuuaucauaaauguaacaaugagugcauggaauccgugaagaacggcacguacgacuaucccaaguacagcgaggaaucuaaacugaaucgcgagaagauugaugggguuaaacuggaguccaugggaguguaucagauccucgcuauuuacagcacagucgccuccucucuggugcuucugguuagccucggcgccaucuccuucuggaugugcucuaacgggagccugcaguguagaaucugcauuuga

SEQ ID NO: 192675 - RNA, 1698 nt, Artificial Sequence
  derived and/or modified sequence opt5 from hemagglutinin__InfluenzaA__AFO66191
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcgaaugggaaccucauugccccuugguaugcuuucgcccuguccagaggauuuggcagcggcaucauuaccucuaaugcucccauggaugagugugacgccaagugccagacaccgcaaggggcgaucaacuccagccuuccuuuccagaaugugcaccccgucaccaucggagaauguccuaaguacgugcggucugccaaacugcgcaugguuaccggccucagaaacauucccagcauccagucccgggggcuguuuggagcuauugccggcuucaucgaagggggauggacaggcaugguggauggcugguauggguaccaucaccagaaugaacaaggaucuggcuacgcugccgaccaaaagagcacgcagaacgccauuaaugggaucaccaacaaagucaauuccgugaucgagaagaugaacacacaguuuaccgcuguuggaaaagaguucaauaagcuggagcgcagaauggagaaccucaacaaaaagguggaugacggcuuccuggauauuuggacauauaaugcggaacuucugguccuccuggagaacgaacggacccuugacuuucacgacagcaaugugaagaaccuguacgagaaagucaagucucagcucaaaaauaacgccaaggaaaucgggaauggcugcuucgaguuuuaucauaaauguaacaaugagugcauggaauccgugaagaacggaacguacgauuaucccaaguacagcgaggaaucuaaacugaaucgcgagaagauugacggcguuaaacuggaguccauggggguguaucagauccucgcuauuuacagcacagucgccuccucucuggugcuucugguuagccucggagccaucuccuucuggaugugcucuaacggcagccugcaguguagaaucugcauuuga

SEQ ID NO: 192676 - RNA, 1698 nt, Artificial Sequence; identical to SEQ ID NO: 183536
  derived and/or modified sequence opt5 from hemagglutinin__InfluenzaA__AFO66202

SEQ ID NO: 192677 - RNA, 1698 nt, Artificial Sequence
  derived and/or modified sequence opt5 from hemagglutinin__InfluenzaA__AFO66213
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaaaagaaagaagugcugguccucuggggagugcaucacccuccgaacaucggcaaccagagagcccuguaccacacagagaaugcuuaugugagcgucguuuccucucauuacagccggcgcuucacccccgaaauugccaagagaccuaaggugcgggaucaggaggggcgcaucaacuauuacuggacgcuucuggaacccggagacacaauuaucuuugaggcgaauggcaaccucauugccccuagauaugcuuucgcccugucccggggguuuggaagcggcaucauuaccucuaaugcucccauggaugagugugacgccaaaugccagacaccgcaaggcgcgaucaacuccagccuuccuuuccagaaugugcaccccgucaccaucggggaauguccuaaguacgugcgcucugccaaacugagaaugguuaccggacuccggaacauucccagcauccagucccgcggccuguuuggggcuauugccggauucaucgagggcggguggacaggaaugguggauggcugguauggcuaccaucaccagaaugaacaagggucuggauacgcugccgaccaaaagagcacgcagaacgccauuaauggcaucaccaacaaagucaauuccgugaucgagaagaugaacacacaguuuaccgcuguugggaaagaguucaauaagcuggaaagacggauggagaaccucaacaagaaaguggaugacggauuccuggauauuuggacauauaaugcggaacuucugguccuccuggagaacgaacgcacccuugacuuucacgacagcaaugugaagaaccuguacgagaaagucaagucucagcucaaaaauaacgccaaggaaaucggcaaugggugcuucgaguuuuaucauaaguguaacgaugagugcauggaauccgugaaaaauggcacguacgacuaucccaaguacagcgaggaaucuaaacugaacagagagaagauugauggaguuaaacuggaguccaugggcguguaucagauccucgcuauuuacagcacagucgccuccucucuggugcuucugguuagccucggggccaucuccuucuggaugugcucuaauggaagccugcagugucggaucugcauuuga

SEQ ID NO: 192678 - RNA, 1698 nt, Artificial Sequence
  derived and/or modified sequence opt5 from hemagglutinin__InfluenzaA__AFO66224
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuagauaugcuuucgcccugucccggggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcgcucugccaagcugagaaugguuaccggacuccggaacauucccagcauccagucccgcggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagagacggauggaaaaccucaacaagaagguggaugacggauuccuggauauuuggacauauaaugcggagcuucugguccuccuggaaaacgagcgcacccuugacuuucacgacagcaaugugaaaaaccuguacgaaaaggucaaaucucaacucaagaauaacgccaaagagaucggcaaugggugcuucgaguuuuaucauaaguguaacgaugaaugcauggaguccgugaagaauggcacguacgacuaucccaaauacagcgaagagucuaagcugaacagagagaaaauugauggaguuaagcuggaauccaugggcguguaucagauccucgcuauuuacagcacagucgccuccucucuggugcuucugguuagccucggggccaucuccuucuggaugugcucuaauggaagccugcagugucggaucugcauuuga

SEQ ID NO: 192679 - RNA, 1698 nt, Artificial Sequence
  derived and/or modified sequence opt5 from hemagglutinin__InfluenzaA__AFO66235
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgugcagcgcgcccuguaccauaccgaaaacgcuuacgucagcguuguguccucucacuauagcagaaaguucacacccgagauugccaaacggccuaaggugcgcgaucaggaagggagaaucaauuacuauuggacccuucuggagcccggagacacgauuaucuuugaggcgaacggcaaucucauugccccucgguacgcuuucgcccugucccgcggguuuggaagcggcaucauuaacucuaaugcucccauggaugaaugugacgccaaaugccagacaccgcaaggcgcgaucaacuccagccuuccuuuccagaauguccaucccgugaccaucggggaguguccuaaguauguuagaucugccaaacugcggauggugacaggacuccgcaacauucccagcauccaguccagaggccuguuuggggcuauugccggauucaucgaaggcggguggaccggaauggucgauggcugguacggcuaucaccaccagaaugagcaagggucuggauacgcugccgaccagaaguccacccagaacgccauuaauggcaucacaaacaaagugaauagcguuaucgaaaagaugaacacgcaguuuaccgcuguggggaaggaguucaauaaacuggagcggcgcauggaaaaccucaacaagaaagucgaugacggauucauugauaucuggacauacaaugcggagcugcuugugcugcucgaaaacgagagaacccuggacuuucaugacagcaaugucaagaaccuuuaugaaaaagugaagucucaacugaagaauaacgccaaagagauuggcaaugggugcuucgaguuuuaccacaaguguaacgaugaaugcauggaguccguuaaaaauggcacauaugacuaccccaaguauagcgaagagucuaaacucaaccgggagaagaucgauggagugaagcuggaauccaugggcgucuaccagauucuggcuaucuauagcaccguggccuccucucucguucugcuugugagccugggggccaucuccuucuggaugugcucuaauggaagccuccagugucgcauuugcaucuga

SEQ ID NO: 192680 - RNA, 1698 nt, Artificial Sequence
  derived and/or modified sequence opt5 from hemagglutinin__InfluenzaA__AFO66246
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcaaccagcgcgcccuguaccauaccgaaaaugcuuacgugagcgucguuuccucucacuauagcagaaaguucacacccgagauugccaaacggccuaaggugcgcgaucaggaagggagaaucaacuacuauuggacccuucuggagcccggagacacgauuaucuuugaggcgaauggcaaccucauugccccucgguacgcuuucgcccugucccgcggguuuggaagcggcaucauuaauucuaacgcucccauggaugaaugugacgccgagugccagacaccgcaaggcgcgaucaauuccagccuuccuuuccagaacgugcaucccgucaccaucggggaauguccuaaauaugugagaucugccaagcugcggaugguuacaggacuccgcaauauucccagcauccaguccagaggccuguuuggggcuauugccggauucaucgagggcggguggaccggaaugguggauggcugguacggcuaucaccaccagaacgaacaagggucuggauacgcugccgaccagaaaagcacccagaaugccauuaacggcaucacaaauaaggucaacuccgugaucgagaaaaugaauacgcaguuuaccgcuguugggaaggaguucaacaagcuggaacggcgcauggagaaccucaauaaaaagguggaugacggauucauugauaucuggacauacaacgcggaacugcuuguccugcucgagaaugaaagaacccuggacuuucaugacagcaacgugaaaaaucuuuaugagaaggucaaaucucaacugaagaacaaugccaaggagauuggcaacgggugcuucgaauuuuaccacaaauguaaugaugagugcauggaauccgugaagaacggcacauaugacuaccccaaauauagcgaggagucuaagcucaaucgggagaaaaucgauggaguuaagcuggaauccaugggcguguaccagauucuggcuaucuauagcaccgucgccuccucucucgugcugcuuguuagccugggggccaucuccuucuggaugugcucuaacggaagccuccagugucgcauuugcaucuga

SEQ ID NO: 192681 - RNA, 1701 nt, Artificial Sequence
  derived and/or modified sequence opt5 from hemagglutinin__InfluenzaA__AFP33324
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugcagacugaagggaaccgcuccccuccagcugggcaauuguagcaucgccggguggauucugggaaacccugagugcgaaucccucuuuucuaaagagagcugguccuacaucgccgaaacgccgaaucccaagaacggcaccuguuauccuggguacuucgcugacuaugaggagcugcgggaacaacuuucuagcguguccagcuuugagcgcuucgaaauuuuucccaaggauucuuccuggccuaaucauacaguuaccaaaggagugacagccagcugcucucacaacggcaaguccagcuucuacaaaaaucugcucuggcugaccggcaagaacgggcuuuaucccaaucugucuaaauccuacgucaacaagaagggaaaagaggugcucguucuguggggcgugcaucacccuagcaauaugggggaccagagagcuaucuaccacaaggagaacgccuaugucuccgugcugucuagccauuacucccggcgcuuuacgccggaaaucgcgaaaagacccaaggugcgggaucaggagggacgcauuaacuauuacuggacacuccuggaaccuggcgacaccaucauuuucgaggccaaugggaaccuuaucgcucccugguaugccuuugcucugagcagaggauucggcucuggcauuaucauuuccaaugccagcaugggggaaugugaugcgaaaugccagacaccucaaggagccaucaacucuagccuccccuuucagaauguccacccgguuaccaucggcgaguguccuaaguacgugcgguccaccaaacugcgcauggugacagggcuuagaaacguccccucuauucagagccggggacuguucggcgcuaucgccggguuuauugagggaggcuggacgggcaugaucgacgggugguauggauaccaucaccagaaugaacaaggcuccggguacgcugccgaucagaagucuacccagaacgccauuaauggaaucacaaacaaggugaauagcaucauugagaaaaugaacacccaguucacagcuguuggcaaggaguucaauaaacucgaacgcagaauggaaaaccugaauaagaaaguggacgauggguuucuggacaucuggaccuauaacgcggagcuccugguccuucuggagaacgaacggacgcucgacuuccacgauuccaaugugaagaaccuguacgagaagguuaaaacacaacuuaagaauaacgccaaagaaauuggcaauggaugcuuugaguucuaucauaaguguaacaaugaaugcauggagagcgugaaaaacggcaccuacgacuauccuaaguacucuaaggaguccaaacugaaucgcgaaaagaucgauggggucaaacucgagagcaugggaguguaucagauucuggcuaucuacuccaccgucgccucuagccuggugcuccugguuucccuuggcgccaucucuuuuuggaugugcagcaacgggucccugcaguguagaauuugcaucuga

SEQ ID NO: 192682 - RNA, 1698 nt, Artificial Sequence
  derived and/or modified sequence opt5 from hemagglutinin__InfluenzaA__AFP33325
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucccgaaagaguccuggucuuacauuguggaaacccccaauccugagaacggcacguguuaucccggguacuuugccgacuaugaggaacugagagagcaacucagcuccgucucuagcuucgaacgguuugagaucuucccuaaggaguccagcuggcccucucauaccgugacaggaguuuccgccagcugcucucacaauggcaaguccagcuuuuaccgcaaccugcuuuggcugaccggcaaaaaugggcucuauccuaaccugucuaaguccuacagcaauaacaaagaaaaggaggugcugguccucuggggagugcaucacccgcccaauaucggcgaucagagagcucuguaccacacagaaaacgccuauguguccgucguuucuagccauuacucccggcgcuucaccccugagauugcuaaaagacccaaggugcgggggcaggaaggacgcaucaacuauuacuggacgcuucuggagccuggcgacacaauuaucuuugaggccaaugggaaccucauugcgcccugguaugccuucgcucugagcagaggauuuggcucuggcaucauuaccuccaaugccccgauggaugaaugugacgcuaagugccagacaccucaaggggccaucaacagcucucuucccuuccagaaugugcacccugucaccaucggagagugucccaaauacgugcggagcgcgaagcugcgcaugguuaccggccucagaaacauucccuccauccagucucgggggcuguuuggagccauugcuggcuucaucgaagggggauggacaggcaugguggauggcugguauggguaccaucaccagaaugagcaaggaagcggcuacgccgcugaccagaaauccacgcagaacgccauuaaugggaucaccaacaaggucaauagcgugaucgaaaagaugaacacacaguuuaccgccguuggaaaagaguucaauaaacuggagcgcagaauggaaaaccucaauaagaagguggaugacggcuuccuggauauuuggacauauaacgcugagcuucugguccuccuggaaaacgagcggacccuugacuuucacgacucuaaugugaaaaaccuguacgaaaaggucaaaucccaacucaagaauaacgcgaaagagaucgggaauggcugcuucgaguuuuaucauaaguguaacgaugaaugcauggagagcgugaagaauggaacguacgacuauccuaaauacucugaagaguccaagcugaaccgcgagaaaauugauggcguuaagcuggaaagcauggggguguaucagauccucgccauuuacuccacagucgcuucuagccuggugcuucugguuucccucggagccaucucuuucuggaugugcagcaauggcucccugcaguguagaaucugcauuuga

SEQ ID NO: 192683 - RNA, 1701 nt, Artificial Sequence
  derived and/or modified sequence opt5 from hemagglutinin__InfluenzaA__AFQ32573
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauacggcgcguguccuagauauguuaaacaaaacacgcugaaacuugccaccgggaugcggaaugugcccgaaaagcagacacgcggaaucuucggcgcuauugccggguuuaucgagaacggaugggaaggcaugguggacgggugguacggauucagacaccaaaauuccgagggccggggccaggcugccgaucugaagucuacccaggccgcuaucgaccagauuaacgggaaacucaacagacugaucggaaagacaaaugagaaauuccaucagauugaaaaggaguuuagcgaagucgagggccgcauccaagaucuugaaaaguaugugggggacaccaaaauugaucugugguccuacaacgcggagcuccugguugcccuggagaaucagcacacgaucgaccucacagauagcgaaaugaacaagcuguucgagaaaaccaagaaacagcuucgggaaaaugcugaggacaugggaaacggcugcuuuaagauuuaucauaagugugauaaugccugcaucgggucuaucagaaacggcaccuacgaccacgauguguaucgcgacgaagcccugaauaaccgguuccagauuaaaggagucgagcucaaguccggcuacaaagacuggauccuguggauuagcuuugcuaucucuugcuuccuucuguguguggcccuccugggguuuauuaugugggcgugccaaaagggaaauaucagauguaacaucugcauuuga

SEQ ID NO: 192684 - RNA, 1701 nt, Artificial Sequence
  derived and/or modified sequence opt5 from hemagglutinin__InfluenzaA__AFQ37281
augaaggccauccuggugguccuccuguacaccuucgcuacaacgaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucuaccgaucaacagagccucuaccagaacgcggacgccuacguguucgugggcacguccagauauagcaagaaauuuaagccugagauugcuauccggccgaaaguccgcgauagagaggggcggaugaauuacuauuggacacugguugaacccggagacaagauuaccuucgaggccacaggcaaccugguggugccucgcuacgcuuuugccauggaaagaaacgcggggucuggaaucauuaucuccgauacccccgcccaugacugcaauaccacaugucagacgccuaaaggcgcuaucaacaccagccuccccuuccaaaauguccacccgauuacaaucggcaagugcccuaaguaugugaaaucuaccaagcugcggcuugccacagggcugcgcaacguucccagcauucaguccagaggacucuuuggcgcuaucgccggguucauugagggaggcuggaccgggaugguggacggaugguacggcuaucaucaccagaaugaacagggcucuggguacgccgcugaucugaaaagcacgcaaaacgcgaucgacaagaucacaaauaaagucaacuccgugauugagaagaugaauacccaguuuaccgccguuggaaaggaguucaaccaccuugaaaaacggaucgagaaucugaacaagaaaguggaugacggcuuccucgauauuuggacauacaaugcugaacugcugguccuccuggagaacgaacgcacccuugacuaucaugauagcaaugugaagaaccuguacgagaaagucagaucucagcucaagaacaaugccaaggagaucgggaacggauguuuugaguucuaucacaaaugcgacgauaaguguauggaguccgugaaaaauggcacauacgacuauccuaaguacagcgaagaggccaaacugaaccgggaagagauugaugggguuaaacuugagucuacgcgcaucuaucagauccuggcuauuuacuccaccgccgcgagcucccucgugcuggucgugucucugggcgcuaucagcuuuuggaugugcuccaauggaucucuccaaugcagaauuuguaucuga

SEQ ID NO: 192685 - RNA, 1707 nt, Artificial Sequence
  derived and/or modified sequence opt5 from hemagglutinin__InfluenzaA__AFQ55689
augaacacccagauccuggcccucauugcuugcaugcugaucggcgccaagggggacaaaauuugucuuggacaccaugcgguggcuaauggcacaaaggucaacacgcugaccgagagagggaucgaaguugugaaugccacagagaccguggaaacagccaacaccaaaaagauuugcacacaaggaaaacggcccaccgaucucggccagugugggcugcuuggaacgcugaucggcccuccgcagugcgaccaguuccucgaguuugaugcugaccugaucauugaacgcagagagggcaccgaugucuguuaccccgggaaguucacaaaugaggaaagccugcggcaaauccuccgcggauccggcgggauugacaaggagucuaugggauuuaccuauagcggcaucagaacaaacggggccaccuccgcuugccggcgcucuggaagcuccuucuacgccgaaaugaaauggcugcuuucuaauagcgauaacgcggccuuuccucagaugacgaaguccuauagaaauccccggaacaaaccugcucugauuaucuggggcgugcaccauagcggcucugccacagagcagaccaagcucuacggguccggaaauaaacugauuacaguuggcagcucuaaguaucagcaauccuucacccccagcccuggggcucgcccccaggugaacggacagucuggcagaaucgacuuucacuggcuucugcucgauccgaaugacaccgucacauucacguuuaacggggccuucaucgcgccugaucgggccuccuuuuuccgcggagagagcauuggcgugcaguccgacguuccccuggauucuggcugugaaggggacugcuuucauaauggaggcaccaucgugagcucccugccuuuccaaaacauuaaccccagaacagucgggaaguguccgcgguacgugaaacagaccagccuccugcuugcuacaggaaugcgcaaugugccugagaaccccaaggacagaaaaucucggcacagacgcacccggggccuguucggggccaucgcuggcuuuauugaaaauggaugggagggccucaucgaugggugguauggauucagacaccagaacgcccaaggcgaagggacggccgcugacuacaaguccacacagagcgcgaucgaucagauuaccggaaaacugaaucgccuuaucgacaagaccaaccagcaauuugagcugauugauaaugaguucucugaaaucgagcagcagauuggcaacgucaucaauuggacacgggacagcaugaccgaaguuugguccuacaacgccgagcuccugguggcuauggaaaaucagcauacaaucgaucuggccgacucugagaugaacaaacucuaugagagagugcgcaagcaacugcgggaaaaugccgaggaagaugggacgggcugcuuugagauuuuccacaagugugacgaucagugcauggaaagcaucagaaacaauaccuacgaccauacacaguaucgcgcugagucccuucagaaccggauucaaaucgacccugucaaacugagcucuggauacaaggauauuauccucugguuuuccuucggcgccagcugcuuucugcuucuggcgauugcuauggggcucguguucaucuguaucaaaaacggaaauaugagaugcaccauuuguaucuga

SEQ ID NO: 192686 - RNA, 1701 nt, Artificial Sequence; identical to SEQ ID NO: 191210
  derived and/or modified sequence opt5 from hemagglutinin__InfluenzaA__AFR68153

SEQ ID NO: 192687 - RNA, 1701 nt, Artificial Sequence
  derived and/or modified sequence opt5 from hemagglutinin__InfluenzaA__AFR68163
augaaggccacccuggugguccuccuguacacauucgcuacggccaacgcggacacccuuugcaucggcuaucacgcuaauaacagcacagauaccguugacacagugcuggagaaaaaugugaccgucacacauuccgccaaccuccuggaagauaagcacaaugggaaacuuuguaagcugagaggaguggcuccccuccaucugggcaaaugcaacauugccggguggauccugggaaauccugagugugaaacccucucuacggccagcuccuggucuuacauuguugagaccagcuccucugacaacggcacaugcuauccgggggauuuuaucgacuacgaagaacugcgggagcagcuuagcuccgugagcucuuucgaacgcuuugagauuuuccccaagaccuccagcuggccuaaucacgauucuaacaagggagucacagcugccuguccccaugcgggcgccaaaggcuuuuauaagaaucugaucuggcucgugaaaaaggggaacuccuacccuaaacugagcaagucuuauaucaaugacaagggaaaagaaguucuugugcuguggggcauucaccaccccuccaccacggcugaucaacagagccucuaccagaacgccgacacauacgucuucguggggaccuccagauauucuaagaaauuuaagccugagaucgcuauucggccgaaagugcgcgaucaggagggaagaaugaauuacuauuggacacuggucgaacccggcgacaagaucaccuucgaggccaccgggaaccugguugugccucgguacgcguuugccauggaacgcgaugcuggaagcggcauuaucauuuccgacacacccgugcaugacugcaacacgaccugucaaacaccuaaaggcgccaucaauaccagccuccccuuccagaacauccacccgauuacaaucgggaagugcccuaaguaugucaaaucuaccaagcugagacuugcuacgggacugcggaaugugcccuccauucagagccgcggccucuuuggggccaucgccggauucauugagggcggguggacaggaaugguugauggcugguacggcuaucaucaccagaacgaacaagggucuggauacgcugcggaccugaaaagcacccagaaugccaucgauaagaucaccaacaaagucaauuccgugauugagaagaugaacacacaguuuaccgcugugggcaaggaguucaaucaccuugagaaaagaaucgagaaccugaauaagaaaguugacgauggguuccucgacauuuggacauacaacgccgaacugcuggugcuccuggagaaugaacggacgcuugauuaucaugacucuaacgucaagaaucuguacgagaaagugcgcaaccagcucaagaacaaugccaaggagaucggaaacggcuguuuugaguucuaucacaaaugcgauaauaccuguauggaaagcgucaagaacgggacauacgacuauccuaaauacuccgaagaggcuaagcugaauagagaagagauugauggcgugaaacuugagagcacccggaucuaucaaauccuggccauuuacucuacagcggcuuccagccucguucugguggucucucugggagccaucuccuuuuggaugugcagcaacggcucccuccagugccgcauuuguaucuga

SEQ ID NO: 192688 - RNA, 1701 nt, Artificial Sequence
  derived and/or modified sequence opt5 from hemagglutinin__InfluenzaA__AFR68173
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaagccuccggacgcauuacaguuagcaccaagagaucccagcagucugugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaaacacgcugaaacuugccaccgggaugcggaauguccccgagaagcagacacgcggaaucuucggcgcgaucgccggguuuauugaaaacggaugggagggcaugguugaugggugguauggauucagacaccagaauagcgagggccggggccaagcugccgaccugaaguccacccaggcugccaucgaucagauuaacgggaaacucaauagacugaucggaaagacaaacgaaaaauuccaccagauugagaaggaauuuagcgagguggaaggccgcauccaagaccuugagaaguacguggaggauaccaaaauugaccuguggucuuauaacgccgaacuccuggucgcucuggagaaucagcauacgaucgaucucacagacuccgaaaugaacaagcuguucgagaaaaccaagaaacagcuucgggaaaaugcggaggauauggggaacggaugcuuuaagaucuaccacaagugugacaaugccugcauuggcagcaucagaaacgggaccuauaaucaugauguguaccgcgacgaggcucugaacaaucgguuccagauuaaaggcguugaacucaagucuggauacaaagacuggauccuguggauuuccuuugccaucagcugcuuccuucuguguguggcccuccugggcuuuaucaugugggcuugccaaaaggggaacauuagauguaauaucugcauuuga

SEQ ID NO: 192689 - RNA, 1701 nt, Artificial Sequence; identical to SEQ ID NO: 185693
  derived and/or modified sequence opt5 from hemagglutinin__InfluenzaA__AFR84675

SEQ ID NO: 192690 - RNA, 1701 nt, Artificial Sequence; identical to SEQ ID NO: 186046
  derived and/or modified sequence opt5 from hemagglutinin__InfluenzaA__AFR84685

SEQ ID NO: 192691 - RNA, 1701 nt, Artificial Sequence; identical to SEQ ID NO: 185873
  derived and/or modified sequence opt5 from hemagglutinin__InfluenzaA__AFR84694

SEQ ID NO: 192692 - RNA, 1701 nt, Artificial Sequence; identical to SEQ ID NO: 185680
  derived and/or modified sequence opt5 from hemagglutinin__InfluenzaA__AFR84704

SEQ ID NO: 192693 - RNA, 1701 nt, Artificial Sequence
  derived and/or modified sequence opt5 from hemagglutinin__InfluenzaA__AFR84714
augaaggccauccuggugguccuccuguacaccuucgcuacagccaacgcggacacgcuuugcauuggcuauagagcuaauaacagcaccgauacaguugacaccgugcuggagaaaaaugugacagucacccacuccgugaacauccucgaagauaagcauaaugggaaacuguguaaacuucggggaguugcuccccugcaccucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgcgagcagcuguccagcgucucuuccuucgaaagauuugagaucuuccccaagaccagcucuuggccuaaucaugauuccaacaagggagugacagccgcuuguccccacgccggcgcgaaaucuuuuuauaagaaucuuauuuggcugguuaaaaagggcaacagcuacccuaaacucuccaagagcuauaucaaugacaaggggaaagaagugcugguccuuuggggcauucaucaccccuccaccucugccgaucaacagagccuguaccagaacgcugacgccuacguguucgugggauccagccgguauucuaagaaauuuaagccugagaucgcuauucgcccgaaagucagagaucaggaggggcggaugaauuacuauuggacacucguugaacccggagacaagaucaccuucgaggccacgggcaaccugguggugccucgcuacgcguuugccauggaaagaaacgcuggguccggaauuaucaucagcgauacacccguccacgacugcaauaccacaugucaaaccccuaaaggcgccauuaacaccucucugcccuuccagaauauccauccgauuacaaucggcaagugcccuaaguaugugaaaagcacgaagcuccggcuggcuaccgggcuucgcaacguucccuccauucagucuagaggacuguuuggcgccaucgccggguucaucgagggaggcuggacagggaugguggacggaugguacggcuaucaccaucagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagcggaucgaaaaucuuaacaaaaagguggaugacggcuuccuggauauuuggacauacaaugccgagcuccugguccugcucgaaaacgagcgcacccuggacuaucacgauucuaaugugaaaaaccuuuacgagaaggucagaucccagcugaaaaacaaugccaaggaaaucgggaacggauguuuugaguucuaucauaagugcgacaauaccuguauggaaagcgugaaaaacggcacauacgauuauccuaaguacucugaggaagcuaaacucaaucgggaggagaucgacgggguuaagcuggaauccacccgcauuuaucaaauccuugccauuuacagcacaguggcguccucucugguccucgugguuagccugggcgcuaucuccuuuuggaugugcucuaacggaagccugcagugcagaauuuguaucuga

SEQ ID NO: 192694 - RNA, 1701 nt, Artificial Sequence; identical to SEQ ID NO: 185873
  derived and/or modified sequence opt5 from hemagglutinin__InfluenzaA__AFR84724

SEQ ID NO: 192695 - RNA, 1701 nt, Artificial Sequence; identical to SEQ ID NO: 185873
  derived and/or modified sequence opt5 from hemagglutinin__InfluenzaA__AFR84734

SEQ ID NO: 192696 - RNA, 1701 nt, Artificial Sequence; identical to SEQ ID NO: 185873
  derived and/or modified sequence opt5 from hemagglutinin__InfluenzaA__AFR84754

SEQ ID NO: 192697 - RNA, 1701 nt, Artificial Sequence; identical to SEQ ID NO: 185873
  derived and/or modified sequence opt5 from hemagglutinin__InfluenzaA__AFR84764

SEQ ID NO: 192698 - RNA, 1701 nt, Artificial Sequence; identical to SEQ ID NO: 185873
  derived and/or modified sequence opt5 from hemagglutinin__InfluenzaA__AFR84774

SEQ ID NO: 192699 - RNA, 1701 nt, Artificial Sequence
  derived and/or modified sequence opt5 from hemagglutinin__InfluenzaA__AFR84784
augaaggccauccuggugggccuccuguacaccuucgcuacagccaacgcggacacgcuuugcauuggguaucacgcuaauaacagcaccgauacagucgacaccguucuggagaaaaaugugacagugacccauuccgucaacauccucgaagauaagcacaauggaaaacuguguaaacuuagaggcguggcuccccugcaucucgggaagugcaacauugccggauggauccugggcaauccugagugugaaucucugagcacagccuccucuuggagcuacauuguugagaccuccucuagcgacaacgggacgugcuauccgggagauuuuaucgacuacgaagaacuccgggagcagcuguccagcgugucuuccuucgaacgcuuugagaucuuccccaagaccagcucuuggccuaaucacgauuccaacaagggcgucacagccgcuuguccccaugccggcgcgaaaucuuuuuauaagaaucuuauuuggcuggugaaaaaggggaacagcuacccuaaacucuccaagagcuauaucaaugacaagggaaaagaaguucuggugcuuuggggcauucaccaccccuccaccucugccgaucaacagagccuguaccagaacgcugacgccuacgucuucgugggguccagcagauauucuaagaaauuuaagccugagaucgcuauucggccgaaagugcgcgaucaggagggaagaaugaauuacuauuggacacucgucgaacccggcgacaagaucaccuucgaggccacggggaaccugguugugccucgguacgcguuugccauggaacgcaacgcuggauccggcauuaucaucagcgauacacccgugcaugacugcaauaccacaugucaaaccccuaaaggcgccauuaacaccucucugcccuuccagaauauccacccgauuacaaucgggaagugcccuaaguaugucaaaagcacgaagcucagacuggcuaccggacuucggaacgugcccuccauucagucucgcggccuguuuggggccaucgccggauucaucgagggcggguggacaggaaugguugacggcugguacggcuaucaucaccagaaugaacaagggagcggauacgcugcggaucucaaauccacccagaacgccauugacgagaucacaaauaaggugaacagcgucauugagaaaaugaauacccaguuuacggcugugggcaaggaguucaaccaccuggagaagagaaucgaaaaucuuaacaaaaagguugaugacggguuccuggauauuuggacauacaaugccgagcuccuggugcugcucgaaaacgagcggacccuggacuaucaugauucuaaugucaaaaaccuuuacgagaaggugcgcucccagcugaaaaacaaugccaaggaaaucggaaacggcuguuuugaguucuaucacaagugcgacaauaccuguauggaaagcgucaaaaacgggacauacgauuauccuaaguacucugaggaagcuaaacucaauagagaggagaucgacggcgugaagcuggaauccacccggauuuaucaaauccuugccauuuacagcacaguugcguccucucuggcucucguggucagccugggagccaucuccuuuuggaugugcucuaacggcagccugcagugccgcauuuguaucuga

SEQ ID NO: 192700 - RNA, 1701 nt, Artificial Sequence; identical to SEQ ID NO: 185873
  derived and/or modified sequence opt5 from hemagglutinin__InfluenzaA__AFR84794

SEQ ID NO: 192701 - RNA, 1701 nt, Artificial Sequence; identical to SEQ ID NO: 185693
  derived and/or modified sequence opt5 from hemagglutinin__InfluenzaA__AFR84804

SEQ ID NO: 192702 - RNA, 1701 nt, Artificial Sequence; identical to SEQ ID NO: 185873
  derived and/or modified sequence opt5 from hemagglutinin__InfluenzaA__AFR84814

SEQ ID NO: 192703 - RNA, 1701 nt, Artificial Sequence; identical to SEQ ID NO: 185693
  derived and/or modified sequence opt5 from hemagglutinin__InfluenzaA__AFR84824

SEQ ID NO: 192704 - RNA, 1701 nt, Artificial Sequence; identical to SEQ ID NO: 185719
  derived and/or modified sequence opt5 from hemagglutinin__InfluenzaA__AFR84834

SEQ ID NO: 192705 - RNA, 1701 nt, Artificial Sequence; identical to SEQ ID NO: 190893
  derived and/or modified sequence opt5 from hemagglutinin__InfluenzaA__AFR84844

SEQ ID NO: 192706 - RNA, 1701 nt, Artificial Sequence; identical to SEQ ID NO: 185935
  derived and/or modified sequence opt5 from hemagglutinin__InfluenzaA__AFR84854

SEQ ID NO: 192707 - RNA, 1701 nt, Artificial Sequence; identical to SEQ ID NO: 185693
  derived and/or modified sequence opt5 from hemagglutinin__InfluenzaA__AFR84864

SEQ ID NO: 192708 - RNA, 1701 nt, Artificial Sequence; identical to SEQ ID NO: 185873
  derived and/or modified sequence opt5 from hemagglutinin__InfluenzaA__AFR84874

SEQ ID NO: 192709 - RNA, 1701 nt, Artificial Sequence; identical to SEQ ID NO: 185680
  derived and/or modified sequence opt5 from hemagglutinin__InfluenzaA__AFR84893

SEQ ID NO: 192710 - RNA, 1701 nt, Artificial Sequence; identical to SEQ ID NO: 185680
  derived and/or modified sequence opt5 from hemagglutinin__InfluenzaA__AFR84903

SEQ ID NO: 192711 - RNA, 1701 nt, Artificial Sequence; identical to SEQ ID NO: 185680
  derived and/or modified sequence opt5 from hemagglutinin__InfluenzaA__AFR84913

SEQ ID NO: 192712 - RNA, 1701 nt, Artificial Sequence; identical to SEQ ID NO: 185680
  derived and/or modified sequence opt5 from hemagglutinin__InfluenzaA__AFR84923

SEQ ID NO: 192713 - RNA, 1689 nt, Artificial Sequence
  derived and/or modified sequence opt5 from hemagglutinin__InfluenzaA__AFV53205
auggccaucauuuaccugauccuccuguucgcuaccgugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccauugcuggauggcuccugggcaauccggagugugaccgccugcucagagugcccgaauggucuuacaucauggagaaagagaacccucgguauagccugugcuaccccgggucccuuaaugauuaugaagaacugaagcaucuccugucuagcguccgccacuuugaaaaggugagaauccuuccuaaagaccgguggacacaacauaccacaaccggagauuccaaggccugugccguuucuggcaaacccagcuucuuucgcaacaugguguggcugacgaagaaaggcccugacuacccggucgcuaagggguccuauaauaacaccagcggagagcagaugcucaucauuuggggcgugcaccaccccaucgaugaggccgaacagagagagcuguaccagaagguugggacauacgugucugcuuccaccagcacacugaauaaacggucuauuccugaaaucgccgcgcgccccgaggucaacggacucagaucccggauggaguucagcuggacccugcuugacgugugggauacgaucaauuuugagucuacaggcaaccugauugccccugaguauggguucaagaucuccaaacgcggaagcuccggcauuaugaagaccgaaggcacacucgggaauugcgagaccaaaugucaaacaccccugggagcuaucaacaccacgcuuccguuucauaacgugcacccucugaccauuggcgaaugccccaaguacgucaaaucugagaagcucguucuggccacagggcugagaaaugugccucagaucgaaagccggggacucuucggcgcuaucgccggguuuauugagggaggcuggcagggcaugguggacgggugguauggauaccaucacuccaacgaucagggcagcggguaugcggccgacaaggagucuacccaaaaggcuuucgacgaaaucacaaauaaagucaacuccgugauugagaaaaugaauacccaguuugaagccguuggaaaggaguucaacaaucuggaaaaacgccuugagaaccugaauaagaagauggaggauggcuuucucgacguguggacguacaacgcugaacugcuuguccugauggagaaugaaagaacacucgauuuccacgacagcaacgugaaaaaucuguaugagaagguucggaugcagcugagagauaacgugaaagagcucgggaauggcuguuucgaauuuuaccauaagugcgacgaugaguguaucaacucugucaaaaacggaaccuacgacuaucccaaguacgaagaggaaagcaagcugaaacgcaaugagauuaagggcgugaaacuuuccucuaugggggucuaucagauccuggccaucuacgccaccguggcuggaagccucucccuggcgauuaugauggccggcaucagcuucuggaugugcucuaacgggucccugcaaugccggauuuguaucuga

SEQ ID NO: 192714 - RNA, 1689 nt, Artificial Sequence
  derived and/or modified sequence opt5 from hemagglutinin__InfluenzaA__AFV53216
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacggagaagggauccaacuauccugucgcuaaaggcagcuacaauaacaccucuggggagcagaugcugaucauuuggggagugcaccacccgaaugacgaaacagagcagcggacccucuaucagaacguuggcacauacguguccgucgggaccagcacgcugaauaagcgcucuacacccgauaucgccaccagaccuaaggugaacggacaaggcggccggauggaauuuuccuggacacugcucgacaugugggauaccauuaacuucgagagcaccgggaaucugaucgcucccgaauacggauuuaaaaucucuaagcgcggcuccagcgggauuaugaaaacagagggaacgcuuggcaacugcgagaccaagugucagacaccucugggggccaucaauaccacacuccccuuccauaacgugcacccgcugaccauuggagaaugcccuaaauaugucaaguccgagaaacuuguucuggcgacgggccucagaaaugugccccagaucgaaucucggggccuguuuggggccauugcuggauucaucgagggcggguggcagggaaugguggacggcugguacggguaucaucacagcaacgaucaaggcuccggauacgccgcugacaaggaaagcacacagaaggccuuugacggcaucaccaauaaagucaacucugugauugagaagaugaauacccaguucgaggcgguugaaaaagaguuuuccaaccuggaacgcagacucgagaaucugaacaagaaaauggaagauggguuccuugacguguggacauauaaugccgagcugcucguccugauggagaacgaacggacccuugauuuccacgacagcaaugugaagaaccuguacgauaagguucgcaugcagcucagagacaacgugaaagagcugggaaauggcuguuuugaguucuaucauaagugcgaugacgaguguaugaacucugucaaaaaugggacauacgauuacccuaaguaugaggaagagagcaaacugaaccggaaugaaaucaagggagugaagcucuccucuaugggcauuuaccaaauccuggcuauuuaugccacggucgcugggagccuuucccuggccaucaugauggccggcaucagcuuuuggaugugcucuaacggaucccuccagugcagaauuuguaucuga

SEQ ID NO: 192715 - RNA, 1689 nt, Artificial Sequence
  derived and/or modified sequence opt5 from hemagglutinin__InfluenzaA__AFV53227
augaucauuaucuaccugauucuccuguucaccgccgugagaggcgaccagaucugcauuggguaucacgcuaacaauagcacagagaaggucgauacgauccuugaacggaacguuaccgugacacaugccaaagacauccuggagaagacccacaauggaaaacucuguaagcugaacggcauucccccucuugaacugggggauugcuccaucgcgggauggcuccugggcaauccggagugugaccgccugcucagagugcccgaauggucuuacauuauggagaaagagaacccucgguauagccugugcuaccccggguccuuuaaugauuaugaggaacuuaagcaucugcucucuagcgucaagcacuucgaaaaagugaagauccugccuaaagacggauggacacaacauaagaccgauggcggcuccaaggcuugugccguuucugggaaagccagcuuuuuccgcaacaugguguggcuuacaaaggagggacccaauuaccaggucgcuaaaagauccuauaacaauaccagcggcgagcagaugcugauuaucuggggagugcaccacccuaaggacgaagccgagcagauugcucucuaccaaaaaguugggacguacgugucugccuccaccagcacacugaacaagcggucuaccccggaaaucgcggcccgccccgaggucaauggccugggguccagaauggaauuuagcuggacacuccuggaugugugggacaccaucaacuucgagucuacgggaaaucuuguggcuccugaguauggcuuuaaaauuuccaagcggggcagcuccgggaucaugaaaacagaaggaacccugggcaacugcgagacaaagugucagacaccccucggggccauuaacaccacccugccuuuccauaauguccacccccuuacgaucggagaaugcccgaaguacguuaaaucugagaagcuggugcucgcuaccggccugcgcaacgugccucagauugaaagcagagggcuguuuggagccaucgcgggcuucaucgagggcggguggcagggaauggucgauggcugguauggguaccaucacuccaaugaccaaggaagcggcuaugccgcugauaaagagucuacacagaaggccuuugaccggauuaccaacaaaguuaauuccgugaucgaaaagaugaacauucaguucgaggcuguggggaaggaauuuagcaaucucgagaaacgccuggaaaaccuuaauaagaaaauggaggacggcuuccuggaugucuggacauacaacgccgagcuccuggugcuuauggaaaaugagagaacccuggacuuccacgauucuaacguuaagaaucucuaugacaaagugcggaugcagcugcgcgauaacgucaaggaacugggaaauggcuguuuugaguucuaccauaagugcgacgaugaguguaugaacagcgugaaaaacgggacguacgacuaucccaaguacgaagaggaauccaaacucaagagaaaugagaucaaaggagucaagcugucuagcaugggcguguaucaaauucuugccaucuacgcuacaguugcggggucccugagccucgccaucaugauugcuggaaucucuuuuuggaugugcuccaacggcagccugcagugccggguguguauuuga

SEQ ID NO: 192716 - RNA, 1689 nt, Artificial Sequence
  derived and/or modified sequence opt5 from hemagglutinin__InfluenzaA__AFV53238
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagaccgcuggacacaacauaccacaaccggaggcuccauggccugugccguuucuggcaagcccagcuuuuucagaaacaugguguggcuuacgaccaaagggccuaauuacccggucgcucagggauccuauaacaauacaagcggcgagcagaugcugaucauuuggggagugcaccaccccaacgaugaggccgaacagcgggcucucuaccaaaagguugggaccuacgugucugccuccacaagcacccuguauaagcgcucuaucccugagauugcggccagacccaaagucaauggccuggggucccggauggaauuuagcuggacgcuccuggacaugugggauacaaucaacuucgagucuaccggaaaucuuguggcuccugaauacggcuuuaagaucuccaaacgcggcagcuccgggauuaugaagacagagggaacccuggagaacugcgaaaccaaaugucagacaccccucggcgccaucaacacgacccugccguuccauaaugugcacccucuuacaauuggggagugccccaaguaugucaaaucugaaaagcugguucucgcuaccggacugagaaacgugccucagaucgagagccggggccuguuuggggccauugcgggauucaucgaaggcggcuggcaggggaugguggacggaugguacggcuaucaucacuccaaugaucaagggagcggauacgccgcugacaaggagucuacacagaaagccuuugauggcaucaccaacaaggucaauuccgugauugagaaaaugaacacgcaguucgaagcuguugggaaggaguuuagcaaucucgaaaaacgccuggagaaccuuaauaagaagauggaagacggcuuccuggacguguggacauauaacgccgagcuccugguccuuauggagaaugaaagaacccuggauuuccacgacucuaacgugaaaaaucucuacgauaagguucggaugcagcugcgcgacaacgugaaagagcugggaaauggcuguuuugaguucuaccauaagugcgauaacgaguguauggacagcgucaaaaacgggaccuaugauuaccccaaguaugaggaagaguccaagcucaauagaaacgaaaucaaaggagugaagcugucuagcaugggcgucuaccaaauucuugccaucuaugcuacaguggcggggucccugagccucgccauuaugauggcuggaaucucuuuuuggaugugcuccaauggcagccugcagugccggaucuguauuuga

SEQ ID NO: 192717 - RNA, 1689 nt, Artificial Sequence
  derived and/or modified sequence opt5 from hemagglutinin__InfluenzaA__AFV53249
auggccaucauuuaccugauccuccuguucgcuaccgugagaggcgaccagauuugcaucggguaucacgccaacaauagcacagagacggucgauaccauucuugaacggaacguuacagugacccaugcgaaggacauccuggagaaaacacacaauggaaagcucuguaaacugaacggcauucccccucuugaacugggggauugcuccaucgcuggauggcuccugggcaauccggagugugaccgccugcucagagugcccgaauggucuuacaucauggagaaggagaacccucgguauagccugugcuaccccgggucccuuaaugauuaugaggaacugaaacaucuccugucuagcgucaagcacuuugaaaaggugcgcauucuuccuaaagacagauggaccaaccauacaaccacgggaggcuccaaggccugugccguuucuggcgagcccagcuucuuucggaauaugguguggcugaccaaaaaggggccuaacuacccggucgcuaaaggauccuauaauaacacaagcggcgagcaaaugcucaucauuuggggagugcaccaccccaaugaugaagccgagcagcgcgcucuguaccagaagguugggaccuacgugucugccuccacaagcacccuguauaagagaucuaucccugaaauugcggcccggcccaaagucaacggccucgggucccgcauggaguucagcuggacgcugcuuaaugugugggacacaaucaacuuugaaucuaccggaaaccugguggcuccugaguacggcuucaagaucuccaaaagaggccggagcgggauuaugaagacagagggaacccucggcaauugcgaaaccaaaugucagacaccccugggggccaucaacacgacccuuccguuucauaauguccacccucugacaauuggagagugccccaaguauguuaaauccgaaaagcucgugcuggcuaccggccugcgcaacgugccucaaaucgagucuagaggacucuucggggccauugcgggcuuuaucgaaggcggguggcagggaauggucgauggcugguacggguaucaucacagcaaugaccagggauccggcuacgccgcugauaaggagagcacacagaaagccuucgacgggaucaccaacaagguuaauucugugauugagaaaaugaacacgcaauuugaagcugugggcaaggaguucaauaaccuggaaaaacggcuugagaaucugaacaagaagauggaagauggauuucucgacgucuggacauauaaugccgagcugcuugugcugauggagaacgaacgcacccucgacuuccacgauuccaauguuaaaaaccuguacgagaaggugagaaugcagcugcgggacaacgucaaagaacucggcaauggguguuucgaguuuuaccauaagugcgaugacgaguguaugaacagcgugaaaaauggaaccuaugauuaccccaaguaugaagaggaaucuaagcugaaaagaaacgagaucaagggcgucaaacuuagcuccauggggguguaccagauucuggccaucuaugcuacaguugcgggaucucucagccuggccauuaugguggcuggcaucuccuucuggaugugcagcaaugggucucugcagugccgcaucuguauuuga

SEQ ID NO: 192718 - RNA, 1698 nt, Artificial Sequence
  derived and/or modified sequence opt5 from hemagglutinin__InfluenzaA__AFV53260
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaaaagccccgcugcagcugggcaauuguaacauugccggguggguccucggaaauccugagugcgaaucccugcuuucuaaccggagcugguccuauaucgcugagacccccaauucugaaaacggcacauguuaccccggggauuucgccgacuaugaggagcugcgcgaacaacucagcuccgugagcucuuuugagagauucgaaauuuuuccuaaggagcgguccuggcccaaucauaccacgcgcggaguuaccgcugccugcccucacgcgaugaaaagcucuuucuacaagaaccugguguggcuuacagaggccaauggcuccuaucccaaccugagcagaucuuacgucaauaaccaggaaaaggaggugcucguucuguggggcgugcaucacccuuccaacaucgaagaucagcggacccuguaucgcaaagacaaugcuuacgucagcgugguguccucuaacuacaauagacgguuuacaccggagaucgccaagcgccccaaagucagagggcagagcggacggauuaacuauuacuggacccuccuggaaccuggcgauacgaucauuuucgaggcuacagggaaucuuaucgcccccugguaugcguuugcccugucccgcggaccuggcagcgggauuaucaccucuaacgcuccccucgacgagugugauacaaagugccaaaccccgcagggagccauuaauuccagccugccuuuccagaacauccaccccguuaccaucggcgaauguccuaaguacgugagaucuacaaaacuucggauggugacgggccugcgcaauauucccagcuuucaguccagaggacucuucggggcuaucgccggcuuuauugaagggggauggaccggcaugauggacgggugguauggauaccaucaccaaaacgagcagggcucuggcuaugccgcugaucaaaagagcacacagaaugcgaucaacgggauuaccaauaaagucaacuccgugaucgagaagaugaauacacaguucaccgccguuggaaaagaauuuaacaagcuggagaaacggauggagaaccugaauaagaagguggacgacggcuuccucgauaucuggacguacaacgcugaacugcuuguccugcucgagaaugaaagaacacuggacuuccaugauagcaacgugaaaaaucuuuacgagaagguuaaaaaccagcugcgcaauaacgccaaggaacucgggaauggaugcuuugaguucuaucacaaaugugacaacgagugcauggaaucugugaagaauggcaccuacgauuaucccaaguacuccgaggaaagcaaacugaaccgggagaagauugacggggucaaacuggagucuaugggcguguauagaauccucgccauuuacuccaccgucgcuagcucccuggugcuucugguuucucucggagccaucagcuuuuggaugugcuccaauggcucucugcagugucgcauuugcaucuga

SEQ ID NO: 192719 - RNA, 1689 nt, Artificial Sequence
  derived and/or modified sequence opt5 from hemagglutinin__InfluenzaA__AFV53271
auggccaucaccuaccugauucuccuguucacagcugugagaggcgaccagaucugcauuggguaucacgccaacaauagcacggagaaggucgauaccauccuugaacggaacguuacagugacccaugcgaaagacauucuggagaagacacacaauggaaaacucuguaagcugaacggcauucccccucuugaacugggggauugcuccaucgcuggauggcuccugggcaauccggagugugaccgcuuucugagagugcccgaauggucuuacaucauggagaaagagaacccucgguauagccucugcuaccccggguccuucaaugauuaugaagaacugaagcaucuucugucuagcgucaagcacuuugaaaaagugaagauccucccuaaagacggauggacccaacauacaaccacgggcggcuccauggccugugccguuucugggaagcccagcuucuuucgcaacaugguguggcugaccgagaaaggacagaauuacccugucgcuaagggcuccuauaacaauacaagcggggagcagaugcuuauuaucuggggagugcaccacccgaacgaugaagccgagcagagagcucuguaccaaaagguuggcaccuacgugucugccuccacaagcacccucaauaaacggucuacgcccgaaauugcggcccgcccuaaggucaacgggcugggauccagaauggaguucagcuggacacugcucgacaugugggauaccaucaauuuugaaucuacaggcaaccugguggcucccgaguauggcuucaaaauuuccaagcgggggagcuccggaaucaugaaaaccgagggcacccuugaaaacugcgagacaaagugucagacgccucugggggccaucaauaccacacuccccuuucauaacgugcacccgcugaccauuggagaaugcccuaaauacgucaagucugagaaacuuguucuggcuacaggccuccgcaauaucccccagauugaaagcagagggcuguucggagccaucgcgggcuuuauugagggcggguggcagggaaugguggacggcugguauggguaccaucacuccaacgaucaaggaagcggcuaugccgcugacaaggagucuacccagaaggccuucgaugggaucacgaauaaagugaacuccgucaucgaaaagaugaauacacaguuugaggcugugggcaaagaguucagcaaccuggagaagcggcucgaaaaucugaacaagaaaauggaggacggauuccuugacguuuggaccuacaaugccgagcugcucgugcugauggaaaacgagcgcacccuugauuuucacgacucuaaugucaagaaccuguaugauaaagugagaaugcagcuccgggacaauguuaaggaacugggcaacggguguuucgaguuuuaccauaaaugcgauaacgaguguauggacagcgugaagaauggaacauacgauuauccuaaguacgaagaggaauccaaacugaaccgcaaugagauuaagggcgucaaacucucuagcauggggguguaucaaauccuggccauuuacgcuaccgucgcgggaucccuuagccuggccaucaugauggcuggcauuucuuucuggaugugcuccaacgggagccuccagugcagaaucuguaucuga

SEQ ID NO: 192720 - RNA, 1689 nt, Artificial Sequence
  derived and/or modified sequence opt5 from hemagglutinin__InfluenzaA__AFV53282
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggaaccaacuauccugucgcuaagggcuccuacaauaacacaagcggggagcagaugcugaucauuuggggagugcaccacccgaaugacgagaccgaacagcggacacucuaucagaacguuggcaccuacgugucugucgggacguccacacugaauaagcgcagcacccccgagaucgccacaagaccuaaagugaacggacugggcucucggauggaauuuuccuggacccuccuggauaugugggacaccauuaacuucgagagcacaggcaaucuuaucgcucccgaauacggguuuaagaucucuaaacgcggauccagcggcauuaugaagacggaggggacccuggagaacugcgaaacaaaaugucaaaccccucucggagccaucaauacaacccugcccuuccauaacgugcacccgcuuacgauuggcgagugcccuaaguaugucaaacuggaaaagcucguucuggcgacagggcugagaaaugugccccagaucgagucccggggacucuuuggcgccauugcuggcuucaucgaagggggauggcagggcaugguggaugggugguacggauaucaucacucuaacgaccagggcagcggguacgccgcugauaaggaguccacccaaaaagccuuugacgucaucaccaauaaggugaacagcguuauugagaaaaugaauacacaguucgaagcggugggcaaggaguuuucuaaccuggaacgcagacuugagaaucugaacaaaaagauggaagacggauuccucgaugucuggaccuauaaugccgagcugcuugugcugauggagaacgaacggacacucgacuuccacgauuccaauguuaagaaccuguacgacaaagugcgcaugcagcugagagauaacgucaaggagcucggcaauggguguuuugaguucuaucauaaaugcgacgaugaguguaugaacagcgugaagaauggaacguacgacuacccuaaauaugaggaagagucuaagcugaaccggaaugaaaucaagggcgucaaacuuagcuccauggggguguaccagauucuggcuaucuaugccaccguugcuggaucucucagccuggccauuaugauggccggcaucuccuuuuggaugugcagcaacgggucucugcaaugcagaaucuguauuuga

SEQ ID NO: 192721 - RNA, 1689 nt, Artificial Sequence
  derived and/or modified sequence opt5 from hemagglutinin__InfluenzaA__AFV53293
auggccaucauuuaccugauccuccuguucaccagcgugagaggcgaccagauuugcaucggguaucacgcuaacaauuccacagagaaggucgauacgauucuugaacggaacguuaccgugacacaugccaaaaauauccuggagaagacccacaacggaaaacucuguaagcugaauggcauucccccucuugaacugggggacugcucuaucgcgggauggcuccugggcaacccggagugugaucgccugcucagagugcccgaauggagcuacaucauggagaaagagaauccuaaguauucccugugcuaccccgggucuuuuaacgacuaugaggaacuuaagcaucugcucagcuccgucaaacacuucgaaaaggugaaaauucugccuaaggauggauggacacaacauaccacaaauggcggcucucgggcuugugccguuagcgggaaccccuccuuuuuccgcaauaugguguggcuuaccaaaaagggaccuaacuacccggucgccaagggcagcuauaauaacacgucuggggagcagaugcugaucauuuggggagugcaccaccccaaugacgaggcugaacagagagcccucuaccaggagguuggcaccuacguguccgcuagcacaucuacccugaacaaacgguccacaccugaaaucgccgcgcgccccaaggucaacgggcugggaagcagaauggaguuuucuuggacccuccuggauaugugggacacgauuaauuucgaauccacaggcaaccuuguggccccugaguauggcuuuaaaaucagcaagcggggguccucuggagugaugaaaaccgagggcacacuggaaaauugcgagaccaagugucaaacaccccucggggcuaucaacaccacgcugccguuccauaauguccacccucuuaccauuggagaaugccccaaauacguuaagagcgagaagcuggugcucgccacaggccugcgcaacgugccucagaucgaauccagagggcuguuuggagcuauugccggcuucaucgagggcggguggcagggaauggucgauggcugguauggguaccaucacagcaaugaccagggaucuggcuaugcggccgauaaagaguccacccaaaaggcuuuugacgggauuacaaacaaagugaauagcguuaucgaaaagaugaacacccaguucgaggccgugggcaaagaauuuucuaaucucgagaagcggcuggaaaaccuuaauaagaaaauggaggauggauuccuggacgucuggacguacaacgcugagcuccuggugcuuauggaaaaugagcgcacacuggacuuccacgauagcaacguuaagaaccucuaugacaaagugagaaugcagcugcgggauaaugucaaggaacugggcaacggguguuuugaguucuaccauaaaugcgacgaugaguguauggacuccgugaagaauggaaccuacgauuaucccaaguacgaagaggaaucuaaacucaaccgcaaugagaucaagggcgucaaacugagcuccauggggguguaucagauucuugccaucuacgccaccguugcuggaagccugucucucgcgauuaugauggccggcaucuccuuuuggaugugcagcaacgggucucugcaaugcagaauuuguaucuga

SEQ ID NO: 192722 - RNA, 1689 nt, Artificial Sequence
  derived and/or modified sequence opt5 from hemagglutinin__InfluenzaA__AFV53304
auggccaucauuuaccugauccuccuguucaccgcugugagaggcgaccagauuugcaucggguaucacgccaacaauagcacagagaaggucgauacgauucuugaacaaaacguuaccgugacacaugcgaaagacauccuggagaagacccacaauggaaaacucuguaagcugaacggcauucccccucuugaacugggggauugcuccaucgcuggauggcuccugggcaauccggagugugaccggcugcucucugugcccgaauggagcuacaucauggagaaagagaacccucgcgaugggcugugcuaucccggauccuuuaaugacuacgaagaacuuaagcaucugcucucuagcgucaagcacuucgaaaaagugaagauucugccuaaagauagauggacacagcauaccacaaccggcggcucccgggccugugccguuucugggaaccccagcuuuuuccgcaauaugguguggcuuacgaagaaagaguccaacuauccugucgcuaagggaagcuacaauaacaccucuggcgagcagaugcugaucauuuggggagugcaccacccgaaugacgaaacagagcagagaacccucuaucaaaacguugggacauacguguccgucggcaccagcacgcugaauaagcggucuacacccaacaucgccacccgcccuaaagugaacgggcugggauccagaauggaauuuagcuggacacuccuggauaugugggacaccauuaauuucgagucuaccggcaaccuuaucgcucccgaauacggcuuuaagaucuccaaacgggggagcuccggaauuaugaagacagagggcacgcuggagaauugcgaaaccaaaugucagacaccucucggggccaucaacaccacacugcccuuccauaaugugcacccgcuuaccauuggagagugcccuaaguaugucaaaucugaaaagcugguucucgcgacgggccugcgcaacgugccccagaucgagagcagagggcuguuuggagccauugcuggcuucaucgaaggcggguggcagggaaugguggauggcugguacggguaucaucacuccaaugaccaaggaagcggcuacgccgcugauaaggagucuacacagaaagccuuugacgggaucaccaacaaggucaauuccgugauugagaaaaugaacacccaguucgaagcgguuggcaaggaguuuagcaaucucgaacggcgccuggagaaccuuaauaaaaagauggaagacggauuccuggauguguggacauauaacgccgagcuccugguccuuauggagaaugaaagaacccuggacuuccacgauucuaacgugaagaaccucuacgacaaaguucggaugcagcugcgcgauaaugugaaggagcugggcaacggguguuuugaguucuaucauaaaugcgacgaugaguguaugaauagcgucaagaacggaacauacgacuacccuaaauaugaggaagaguccaagcucaauagaaacgaaaucaagggcgugaaacugucuagcaugggggucuaccaaauucuugcuaucuaugccacgguggcuggaucccugagccucgccauuaugauggccggcaucucuuuuuggaugugcuccaaugggagccugcagugccggaucuguauuuga

SEQ ID NO: 192723 - RNA, 1689 nt, Artificial Sequence
  derived and/or modified sequence opt5 from hemagglutinin__InfluenzaA__AFV53314
auggccaucauuuaccugauccuccuguucaccgcugugagaggcgacaagauuugcaucggguaucacgccaacaauagcacagagacggucgauaccauucuugaacggaacguuacagugacccaugcgaaagacauccuggagaagacacacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagaaaugggcugugcuaucccggaaacuuuaaugauuacgaggaacuuaagcaucugcucuccucugucaagcacuucgaaaaagugaagauucugccuaaagaccgguggacccagcauacaaccacgggcggcagccaagccugugccguuuccgggaaccccagcuuuuuccgcaauaugguguggcuuaccgagaaggagucuaacuauccugucgcuaaaggauccuacaauaacacaagcggcgaacagaugcugaucauuuggggagugcaccacccgaucgaugagaccgaacagagaacacucuaucagaauguugggaccuacgugucugucggcacguccacacugaacaagcggagcacccccgagauugccaagcgcccuaaagugaacgggcugggaucuagaauggaauuuuccuggacacuccuggacaugugggauaccaucaccuucgagagcacaggcaaucuuaucgcucccgaguacggcuuuaagauuucuaaacggggguccagcggaaucaugaagacggaaggcacccuggagaacugcgaaacaaaaugucaaaccccucucggggccauuaauacaacccugcccuuccauaacgugcacccgcuuacgaucggagagugcccuaaguaugucaaauccgaaaagcugguucucgcgacaggccugcgcaaugugccccagauugagucuagagggcuguuuggagccaucgcuggcuucaucgagggcggguggcagggaaugguggacggcugguacggguaucaucacagcaacgaucagggauccggcuacgccgcugacaaggaaagcacccaaaaagccuuugaugggauuaccaauaaggucaacgcggugaucgagaaaauuaauacacaguucgaagccguuggcaaggaguuuucuaaccucgaacggcgccuggagaaucuuaacaaaaagauggaggacggauuccuggacguguggaccuauaaugcugaacuccugguccuuauggagaacgaaagaacacuggauuuccacgacuccaaugugaagaaccucuacgauaaaguucggaugcagcugcgcgacaacgugaaggagcugggcaauggguguuuugaguucuaucauaaaugcgaugacgaauguaugaacagcgucaagaauggaacguacgauuacccuaaauaugaggaagagucuaagcucaacagaaaugaaaucaagggcgugaaacugagcuccaugggggucuaccagauucuugccaucuaugcuaccguggccggaucucugagccucgccaucaugauggcuggcauuuccuuuuggaugugcagcaacgggucucugcaaugccggaucuguauuuga

SEQ ID NO: 192724 - RNA, 1689 nt, Artificial Sequence
  derived and/or modified sequence opt5 from hemagglutinin__InfluenzaA__AFV53325
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauaccgucgcuaagggcagcuacaauaacacaucuggggagcagaugcugaucauuuggggagugcaccacccuaaugacgagaccgaacagcggacacucuaucagaacguuggcaccuacguguccgucagcacgucuacacugaauaagcgcuccaccccggagaucgccacaagacccaaagugaacgggcugggaagccggauggaauuuucuuggacccuccuggauaugugggacaccauuaacuucgaguccacaggcaaucuuaucgcuccugaauacggcuuuaagaucagcaaacgcggguccucuggaauuaugaagacggagggcacccuggagaacugcgaaacaaaaugucaaacaccccucggggccaucaauaccacccugccuuuccauaacgugcacccccuuacgauuggagagugcccgaaguaugucaaaagcgaaaagcugguucucgcgacaggccugagaaaugugccucagaucgagucccgggggcuguuuggagccauugcuggcuucaucgaaggcggguggcagggaaugguggauggcugguacggguaucaucacagcaacgaccagggaucuggcuacgccgcugauaaggaguccacccaaaaagccuuugacgggaucaccaauaaggucaacagcgugauugagaaaaugaauacacaguucgaagcgguuggcaaggaguuuucuaaccucgaacgcagacuggagaaucuuaacaaaaagauggaagacggauuccuggauguguggaccuauaaugccgagcuccugguccuuauggagaacgaacggacacuggacuuccacgauagcaaugugaagaaccucuacgacaaaguucgcaugcagcugagagauaacgugaaggagcugggcaauggguguuuugaguucuaucauaaaugcgacgaugaguguaugaacuccgucaagaauggaacguacgacuaccccaaauaugaggaagagucuaagcucaaccggaaugaaaucaagggcgugaaacugagcuccaugggggucuaccagauucuugcuaucuaugccaccguggcuggaagccugucucucgccauuaugauggccggcaucuccuuuuggaugugcagcaacgggucucugcaaugcagaaucuguauuuga

SEQ ID NO: 192725 - RNA, 1689 nt, Artificial Sequence
  derived and/or modified sequence opt5 from hemagglutinin__InfluenzaA__AFV53336
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcaccuggaaaaagugaagauucuuccuaaagacggauggacacaacaugagaccgauggcggcuccaaggccugugccguuucugggaaacccagcuucuuucgcaacaugguguggcugacaaagaagggaccuaauuacccggucgcuaaaagauccuauaacaauaccagcggcgagcagaugcucaucauuuggggagugcaccaccccaacgacgaagccgagcagcgggcucuguaccagaagguugggacguacgugucugccuccaccagcacacugaauaaacgcucuaccccugaaaucgcggccagacccgaggucuccggccucgggagccggauggaguucucuuggacacugcuugaugugugggacaccauuuccuuugagagcacgggaaaccugguggcuccugaguauggcuucaagaucuccaaacgcggcucuagcgggaucaugaagacagaaggaacccucggcaauugcgagacaaaaugucaaacaccccugggggccauuaacaccacccuuccguuucauaacguccacccucugacgaucggagaaugccccaaguacguuaaguccgagaaacucgugcuggcuaccggccugagaaaugugccucagauugaaagccggggacucuucggggccaucgcgggcuuuauugagggcggguggcagggaauggucgauggcugguauggguaccaucacucuaacgaccagggauccggcuaugccgcugauaaggagagcacacaaaaagccuucgaccgcaucaccaauaaggugaacucuguuaucgagaaaaugaauacacaguuugaagcuguggggaaggaguucagcaaccuggaaaagagacuugaaaaucugaacaaaaagauggaggacggcuuucucgaugucuggaccuacaaugccgagcugcuugugcugauggaaaacgagcggauucucgacuuccacgauuccaauguuaaaaaccuguaugacaaggugcgcaugcagcugagagauaaugucaaagaacucggaaacggcuguuucgaguuuuaccauaagugcgacgaugaguguaugaacucugugaagaaugggacguacgacuaucccaaauacgaagaggaaagcaagcugaaacggaacgagaucaagggagucaaacuuuccagcaugggcguguaucagauucuggccaucuacgcuacaguugcggggucucucucccuggccauuaugaucgcuggaaucagcuucuggaugugcucuaauggcucccugcaaugcagaauuuguaucuga

SEQ ID NO: 192726 - RNA, 1701 nt, Artificial Sequence
  derived and/or modified sequence opt5 from hemagglutinin__InfluenzaA__AFV68720
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcaggcugugaucccgaacauuggcucucggccccgcaucagaaauaucccuagccggauuuccaucuacuggacaauugucaaacccggggacauccugcugauuaacagcaccggaaaucucaucgccccucgcggcuacuucaagaucagaucugggaaauccagcauuaugcggucugacgcucccaucggaaaguguaacagcgaaugcauuaccccgaauggcuccaucccuaacgauaagcccuuucagaaugugaaccgcauuacauauggcgccuguccuagauacgugaaacaaaauacgcugaagcuggcgaccgggaugcggaacguccccgagaaacagacacgcggaaucuucggcgccaucgcuggguuuauugaaaauggaugggagggcaugguugacgggugguauggauucagacaccagaacucugagggccggggccaagccgcugaucuuaagagcacccaggccgccaucgaccagauuaaugggaaacucaacagacugaucggaaagacaaaugaaaaauuccaccagauugagaaggaauuuuccgagguggaaggccgcauccaagaucuugagaaguacguggaggacaccaaaauugaucuguggagcuauaacgcugaacuccuggucgcgcuggagaaccagcauacgaucgaccucacagauucugaaaugaauaagcuguucgagaaaaccaagaaacagcuucgggaaaacgccgaggacauggggaauggaugcuuuaagaucuaccacaagugugauaacgcuugcauuggcuccaucagaaaugggaccuauaaccaugacguguaccgcgacgaggcccugaauaaccgguuccagauuaaaggcguugaacucaagagcggauacaaagauuggauccuguggauuucuuuugccaucuccugcuuccuucuguguguggcucuccugggcuuuaucaugugggccugccaaaaggggaauauuagauguaacaucugcauuuga

SEQ ID NO: 192727 - RNA, 1701 nt, Artificial Sequence; identical to SEQ ID NO: 185693
  derived and/or modified sequence opt5 from hemagglutinin__InfluenzaA__AFX96347

SEQ ID NO: 192728 - RNA, 1701 nt, Artificial Sequence
  derived and/or modified sequence opt5 from hemagglutinin__InfluenzaA__AFX96359
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccuggaaaacgagcggacacuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuauccuaaguacagcgaggaagccaaacugaauagagaggagaucaacggggugaaacuugaaucuacgcggauuuaucaaauccuggcuauuuacuccaccguugccagcucccucgugcuggucgugucucugggcgcgaucagcuuuuggaugugcuccaauggaucucuccagugccgcauuuguaucuga

SEQ ID NO: 192729 - RNA, 1701 nt, Artificial Sequence
  derived and/or modified sequence opt5 from hemagglutinin__InfluenzaA__AFX96366
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacagagggaaggaagugcuuguccuguggggaauccaccaccccuccaccucugccgaucaacagagccucuaccagaacgcugacgccuacguguucgugggcacaucccgguauagcaaaaaguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaaaaugaauacgcaguuuacagcuguuggaaaggaguucaaccagcuugaaaagcggauugagaaucugaacaaaaagguggaugacggcuuccucgauaucuggaccuacaaugccgaacugcugguccuccuggagaacgaacgcacccuugacuaucacgauagcaaugugaaaaaccuguacgagaaggucagaucucaacucaaaaacaaugccaaggagauugggaacggauguuuugaguucuaucauaagugcgacaauacauguauggaguccgugaaaaacggcaccuacgauuauccuaaguacagcgaagaggcuaaacugaaucgggaagagaucgacgggguuaagcuggagucuacacgcaucuaucagauucuggccaucuacuccacgguggcgagcucccucguccuggugguuucucugggcgcuauuagcuuuuggaugugcuccaacggaucucuccagugcagaaucuguauuuga

SEQ ID NO: 192730 - RNA, 1701 nt, Artificial Sequence; identical to SEQ ID NO: 187193
  derived and/or modified sequence opt5 from hemagglutinin__InfluenzaA__AFX96383

SEQ ID NO: 192731 - RNA, 1701 nt, Artificial Sequence; identical to SEQ ID NO: 185693
  derived and/or modified sequence opt5 from hemagglutinin__InfluenzaA__AFX96398

SEQ ID NO: 192732 - RNA, 1701 nt, Artificial Sequence; identical to SEQ ID NO: 185693
  derived and/or modified sequence opt5 from hemagglutinin__InfluenzaA__AFX96408

SEQ ID NO: 192733 - RNA, 1701 nt, Artificial Sequence; identical to SEQ ID NO: 185693
  derived and/or modified sequence opt5 from hemagglutinin__InfluenzaA__AFX96418

SEQ ID NO: 192734 - RNA, 1701 nt, Artificial Sequence; identical to SEQ ID NO: 185693
  derived and/or modified sequence opt5 from hemagglutinin__InfluenzaA__AFX96428

SEQ ID NO: 192735 - RNA, 1701 nt, Artificial Sequence; identical to SEQ ID NO: 185693
  derived and/or modified sequence opt5 from hemagglutinin__InfluenzaA__AFX96438

SEQ ID NO: 192736 - RNA, 1701 nt, Artificial Sequence; identical to SEQ ID NO: 185693
  derived and/or modified sequence opt5 from hemagglutinin__InfluenzaA__AFX96448

SEQ ID NO: 192737 - RNA, 1701 nt, Artificial Sequence; identical to SEQ ID NO: 185693
  derived and/or modified sequence opt5 from hemagglutinin__InfluenzaA__AFX96458

SEQ ID NO: 192738 - RNA, 1701 nt, Artificial Sequence; identical to SEQ ID NO: 185693
  derived and/or modified sequence opt5 from hemagglutinin__InfluenzaA__AFX96468

SEQ ID NO: 192739 - RNA, 1701 nt, Artificial Sequence; identical to SEQ ID NO: 185693
  derived and/or modified sequence opt5 from hemagglutinin__InfluenzaA__AFX96478

SEQ ID NO: 192740 - RNA, 1701 nt, Artificial Sequence; identical to SEQ ID NO: 185693
  derived and/or modified sequence opt5 from hemagglutinin__InfluenzaA__AFX96488

SEQ ID NO: 192741 - RNA, 1701 nt, Artificial Sequence
  derived and/or modified sequence opt5 from hemagglutinin__InfluenzaA__AFX96498
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaaauuuccaagagcuauaucaaugacaaggggaaagaagugcugguccuuuggggcauucaccaccccuccaccucugccgaucaacagagccuguaccagaacgcugacgccuacguguucgugggaacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 192742 - RNA, 1701 nt, Artificial Sequence; identical to SEQ ID NO: 185693
  derived and/or modified sequence opt5 from hemagglutinin__InfluenzaA__AFX96508

SEQ ID NO: 192743 - RNA, 1701 nt, Artificial Sequence; identical to SEQ ID NO: 187193
  derived and/or modified sequence opt5 from hemagglutinin__InfluenzaA__AFX96518

SEQ ID NO: 192744 - RNA, 1701 nt, Artificial Sequence; identical to SEQ ID NO: 185693
  derived and/or modified sequence opt5 from hemagglutinin__InfluenzaA__AFX96528

SEQ ID NO: 192745 - RNA, 1701 nt, Artificial Sequence; identical to SEQ ID NO: 187193
  derived and/or modified sequence opt5 from hemagglutinin__InfluenzaA__AFX96538

SEQ ID NO: 192746 - RNA, 1701 nt, Artificial Sequence
  derived and/or modified sequence opt5 from hemagglutinin__InfluenzaA__AFX96548
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacacauacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacaagauuacgaauaaagucaacuccgugaucgagaagaugaauacacaguuuaccgccguuggaaaggaguucaaccaccuugagaaaagaauugagaaucugaacaagaaaaucgaugacggcuuccucgauauuuggaccuacaaugcugaacugcuggugcuccuggagaacgaacggacacuugacuaucaugauagcaaugucaagaaccuguacgagaaagugcgcucucagcucaagaacaaugccaaggagaucgggaacggauguuuugaguucuaucacaaaugcgacaauaccuguauggaauccgucaagaacggcacauacgauuauccuaaauacagcgaagaggccaagcugaauagagaagagaucgacggggugaaacuugagucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 192747 - RNA, 1701 nt, Artificial Sequence; identical to SEQ ID NO: 185693
  derived and/or modified sequence opt5 from hemagglutinin__InfluenzaA__AFX96558

SEQ ID NO: 192748 - RNA, 1701 nt, Artificial Sequence; identical to SEQ ID NO: 186853
  derived and/or modified sequence opt5 from hemagglutinin__InfluenzaA__AFX96568

SEQ ID NO: 192749 - RNA, 1701 nt, Artificial Sequence; identical to SEQ ID NO: 186853
  derived and/or modified sequence opt5 from hemagglutinin__InfluenzaA__AFX96578

SEQ ID NO: 192750 - RNA, 1701 nt, Artificial Sequence; identical to SEQ ID NO: 185693
  derived and/or modified sequence opt5 from hemagglutinin__InfluenzaA__AFX96588

SEQ ID NO: 192751 - RNA, 1701 nt, Artificial Sequence; identical to SEQ ID NO: 185693
  derived and/or modified sequence opt5 from hemagglutinin__InfluenzaA__AFX96598

SEQ ID NO: 192752 - RNA, 1701 nt, Artificial Sequence
  derived and/or modified sequence opt5 from hemagglutinin__InfluenzaA__AFX96608
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagagaagaucgacgggguuaaacuugagucuacacggaucuaucaaauucuggccaucuacuccacgcucgcgagcucccuggugcuggucgugucucucggcgcuauuagcuuuuggaugugcuccaacggaucucugcagugccgcaucuguauuuga

SEQ ID NO: 192753 - RNA, 1701 nt, Artificial Sequence; identical to SEQ ID NO: 185693
  derived and/or modified sequence opt5 from hemagglutinin__InfluenzaA__AFX96618

SEQ ID NO: 192754 - RNA, 1701 nt, Artificial Sequence; identical to SEQ ID NO: 186853
  derived and/or modified sequence opt5 from hemagglutinin__InfluenzaA__AFX96628

SEQ ID NO: 192755 - RNA, 1701 nt, Artificial Sequence
  derived and/or modified sequence opt5 from hemagglutinin__InfluenzaA__AFX96638
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugguuuggcucgugaaaaagggcaauagcuacccuaaacuguccaagagcuauaucaacgauaaggggaaagaaguccuugugcuguggggcauucaccaccccuccaccucugccgaccaacagagccucuaccagaaugcugaugccuacguguucgucggaacauccagauauagcaagaaauuuaagccugagaucgcuauucggccgaaaguucgcgaccaggaggggagaaugaacuacuauuggacccugguggaacccggagauaagaucacguucgaggccacaggcaaccugauggugccucgguacgcguuugccauggaacgcaaugcugggucuggaauuaucauuuccgacacccccguccaugauugcaacacaaccugucaaaccccuaaaggcgccaucaauacaagccuccccuuccagaacauccacccgauuacgaucggcaagugcccuaaguaugugaaaucuaccaagcugagacuugcuacagggcugcggaauguucccagcauucagucccgcggacucuuuggcgccaucgccggguucauugagggaggcuggaccgggaugguggacggaugguacggcuaucaucaccagaacgaacaaggcucuggguacgcugcggaccugaaaagcacacagaaugccaucgaugagaucaccaacaaggucaauuccgugauugagaaaaugaacacgcaguuuacagcuguuggaaaggaguucaaucaccuugagaagagaaucgaaaaccugaauaaaaagguggacgauggcuuccucgacauuuggaccuacaacgccgagcugcugguccuccuggaaaaugagcggacccuugauuaucaugacagcaacgugaaaaaccuguacgagaagguccgcucucagcucaaaaauaacgccaaggaaaucgggaauggauguuuugaguucuaucacaagugcgauaacacauguauggaauccgugaaaaauggcaccuacgacuauccuaaguacagcgaggaagcuaaacugaacagagaggagauugaugggguuaaacuugaaucuacacggaucuaucaaauccuggccauuuacuccacgguggcgagcucccucguccuggugguuucucugggcgcuaucagcuuuuggaugugcuccaauggaucucuccagugccgcauuuguaucuga

SEQ ID NO: 192756 - RNA, 1701 nt, Artificial Sequence; identical to SEQ ID NO: 185693
  derived and/or modified sequence opt5 from hemagglutinin__InfluenzaA__AFX96648

SEQ ID NO: 192757 - RNA, 1701 nt, Artificial Sequence; identical to SEQ ID NO: 186853
  derived and/or modified sequence opt5 from hemagglutinin__InfluenzaA__AFX96658

SEQ ID NO: 192758 - RNA, 1701 nt, Artificial Sequence
  derived and/or modified sequence opt5 from hemagglutinin__InfluenzaA__AFX96668
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcucuaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 192759 - RNA, 1701 nt, Artificial Sequence
  derived and/or modified sequence opt5 from hemagglutinin__InfluenzaA__AFX96678
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguagccaugccggcgcgaaaucuuuuuauaagaaucugaucuggcucguuaaaaagggcaacuccuaccccaaacugagcaaguccuauauuaaugacaaggggaaagaagugcuuguccuguggggaauccaccacccuucuaccagcgccgaucaacagucccucuaccagaacgcugacgccuacguguucgugggcacaagcagauauucuaagaaauuuaagcccgagauugcuauccggccuaaaguccgcgaucaggaggggagaaugaauuacuauuggacccugguugaaccgggagacaagauuacguucgaggccacaggcaaccugguggugccccgguacgcguuugccauggaacgcaacgcuggguccggaaucauuaucagcgauaccccuguccaugacugcaauacaaccugucaaacccccaaaggcgccaucaacacaucucucccuuuccagaauauucaccccaucacgauuggcaagugcccgaaguaugugaaaagcaccaagcugagacuugcuacagggcugcggaacguuccuuccauccagucucgcggacucuuuggcgccauugccggguucaucgagggaggcuggaccgggaugguggacggaugguacggcuaucaucaccagaaugaacaaggcagcggguacgcugcggaucugaaauccacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuaucccaaguacucugaggaagcuaaacugaauagagaggagaucgacgggguuaaacuugaauccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 192760 - RNA, 1701 nt, Artificial Sequence
  derived and/or modified sequence opt5 from hemagglutinin__InfluenzaA__AFX96688
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugacugugagucucucagcacagccuccucuuggagcuacaucguggaaaccuccucuagcgauaacggcacgugcuauccgggggacuuuauugauuacgaggaacugcgggagcagcuuuccagcgucucuuccuucgagcgcuuugaaauguuccccaagaccagcucuuggccuaaucacgacuccaacaagggagugacagccgcuuguccccaugccggcgcgaaaucuuuuuauaagaaucugaucuggcucguuaaaaagggcaacagcuacccuaaacuguccaagagcuauaucaaugauaaggggaaagaggugcuuguccuguggggcauucaccaccccuccaccucugccgaccaacagagccucuaccagaacgcugaugccuacguguucgugggaacauccagauauagcaagaaauuuaagccugaaaucgcuauucggccgaaaguccgcgaccaggaggggagaaugaauuacuauuggacccugguugagcccggagauaagaucacguucgaagccacaggcaaccugguggugccucgguacgcguuugccauggagcgcaacgacgggucuggaauuaucauuuccgacacccccguccaugauugcaauacaaccugucaaaccccuaaaggcgcuaucaacacaagccuccccuuccagaauauccacccgauuacgaucggcaagugcccuaaguaugugaaaucuaccaagcugagacuugccacagggcugcggaacguucccagcauucagucccgcggacucuuuggcgcuaucgccggguucauugaaggaggcuggaccgggaugguggacggaugguacggcuaucaucaccagaaugagcaaggcucuggguacgccgcugaucugaaaagcacacagaacgcgaucgacgaaaucaccaauaaggucaacuccgugauugagaaaaugaauacgcaguuuacagccguuggaaaggaguucaaccaccuugaaaagagaaucgagaaucugaacaaaaagguggaugacggcuuccucgauauuuggaccuacaaugcugaacugcugguccuccuggagaacgaacggacccuugacuaucaugauagcaaugugaaaaaccuguacgagaagguccgcucucagcucaaaaacaaugccaaggagaucgggaacggauguuuugaguucuaucacaagugcgacaauacauguauggaauccgugaaaaacggcaccuacgauuauccuaaguacagcgaagaggccaaacugaauagagaagagauugacgggguuaaacuugagucuacacggaucuaucaaauccuggcuauuuacuccacgguggccagcucccucguccuggugguuucucugggcgcgaucagcuuuuggaugugcuccaacggaucucuccagugccgcauuuguaucuga

SEQ ID NO: 192761 - RNA, 1701 nt, Artificial Sequence; identical to SEQ ID NO: 185693
  derived and/or modified sequence opt5 from hemagglutinin__InfluenzaA__AFX96698

SEQ ID NO: 192762 - RNA, 1701 nt, Artificial Sequence
  derived and/or modified sequence opt5 from hemagglutinin__InfluenzaA__AFX96718
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaaauuuccaagagcuauaucaaugacaaggggaaagaagugcugguccuuuggggcauucaccaccccuccaccucugccgaucaacagagccuguaccagaacgcugacacauacguguucgugggaaccuccagauauagcaagaaauuuaagccugagaucgccauucggccgaaaguccgcgaucaggaggggagaaugaauuacuauuggacgcucguugaacccggagacaagaucacauucgaggcuaccggcaaccugguggugccucgguacgccuuugcgauggaacgcaacgccgggucuggaauuaucaucuccgauacacccguccaugacugcaauaccaccugucaaacaccuaaaggcgcuauuaacacgagccugcccuuccagaauauccacccgauuaccaucggcaagugcccuaaguaugugaaaucuacaaagcucagacuggccaccgggcuucggaacguucccagcauucagucccgcggacuguuuggcgcuaucgccggguucaucgagggaggcuggacagggaugguggacggaugguacggcuaucaucaccagaaugaacaaggcucuggguacgccgcugaucucaaaagcacccagaaggcgauugacgagaucacgaacaaagucaauuccgugauugagaagaugaacacacaguuuaccgccguuggaaaggaguucaaucaccuggagaaaagaaucgaaaaccuuaauaagaaaauugaugacggcuuccuggauaucuggaccuacaacgcugagcuccuggugcugcucgaaaaugagcggacacuggacuaucaugauagcaacgucaagaaucuuuacgagaaagugcgcucucagcugaagaacaacgccaaggaaaucgggaauggauguuuugaguucuaucacaaaugcgacaacaccuguauggaauccgucaagaauggcacauacgauuauccuaaauacagcgaggaagccaagcucaacagagaggagauugacggggugaaacuggaaucuacgcggaucuaucaaauucuugcuaucuacuccaccguugccagcucccuggugcucgucgugucucugggcgcgauuagcuuuuggaugugcuccaauggaucucugcagugccgcaucuguauuuga

SEQ ID NO: 192763 - RNA, 1701 nt, Artificial Sequence; identical to SEQ ID NO: 192762
  derived and/or modified sequence opt5 from hemagglutinin__InfluenzaA__AFX96728

SEQ ID NO: 192764 - RNA, 1701 nt, Artificial Sequence; identical to SEQ ID NO: 186163
  derived and/or modified sequence opt5 from hemagglutinin__InfluenzaA__AFX96738

SEQ ID NO: 192765 - RNA, 1701 nt, Artificial Sequence
  derived and/or modified sequence opt5 from hemagglutinin__InfluenzaA__AFX96748
augaaggccauccuggugguccuccuguacaccauugcuacagccaacgcggacacgcuuugcaucggcuaucacgcuaauaacagcaccgauacaguugacaccgugauugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuucaucgacuacgaggaacuccgggagcagcuguccagcgucucuuccuuugaacgcuucgagauguuucccaagaccagcucuuggccuaaucacgauuccaacaagggagugacagccgcuuguccccaugccggcgcgaaaucuuucuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguuugugggaacauccagauauagcaagaaauucaagccugagaucgcuauucggccgaaaguccgcgaucaggaggggagaaugaauuacuauuggacccucguugaacccggagacaagaucacguuugaggccacaggcaaccugguggugccucgguacgcguucgccauggaacgcaacgcugggucuggaauuaucaucuccgauacccccguccaugacugcaauacaaccugucaaaccccuaaaggcgccauuaacacaagccugcccuuucagaauauccacccgauuacgaucggcaagugcccuaaguaugugaaaucuaccaagcucagacuggcuacagggcuucggaacguucccagcauucagucccgcggacuguucggcgccaucgccggguuuaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguucacagcuguuggaaaggaauuuaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuucgaguuuuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuucuggaugugcuccaacggaucucugcagugccgcauuuguaucuga

SEQ ID NO: 192766 - RNA, 1701 nt, Artificial Sequence
  derived and/or modified sequence opt5 from hemagglutinin__InfluenzaA__AFX96758
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccaccucugccgaucaacagagccucuaccagaacgcugacacauacguguucgugggaaccuccagauauagcaagaaauuuaagccugagaucgccauucggccgaaaguccgcgaucaggaggggagaaugaauuacuauuggacgcugguugaacccggagacaagaucacauucgaggcuaccggcaaccugguggugccucgguacgccuuugcgauggaacgcaacgccgggucuggaauuaucauuuccgauacacccguccaugacugcaauaccaccugucaaacaccuaaaggcgcuaucaacacgagccuccccuuccagaauauccacccgauuaccaucggcaagugcccuaaguaugugaaaucuacaaagcugagacuugccaccgggcugcggaacguucccagcauucagucccgcggacucuuuggcgcuaucgccggguucauugagggaggcuggacagggaugguggacggaugguacggcuaucaucaccagaaugaacaaggcucuggguacgccgcugaucugaaaagcacccagaacgcgaucgacgagaucacgaauaaggucaacuccgugauugagaaaaugaauacacaguuuaccgccguuggaaaggaguucaaccaccuugagaagagaaucgaaaaucugaacaaaaagauugaugacggcuuccucgauaucuggaccuacaaugcugagcugcuggugcuccuggaaaacgagcggacacuugacuaucaugauagcaaugucaaaaaccuguacgagaaggugcgcucucagcucaaaaacaaugccaaggaaauugggaacggauguuuugaguucuaucacaagugcgacaauaccuguauggaauccgucaaaaacggcacauacgauuauccuaaguacagcgaggaagccaaacugaauagagaggagaucgacggggugaaacuugaaucuacgcggaucuaucaaauucuggcuaucuacuccaccguugccagcucccucgugcuggucgugucucugggcgcgauuagcuuuuggaugugcuccaacggaucucuccagugccgcaucuguauuuga

SEQ ID NO: 192767 - RNA, 1701 nt, Artificial Sequence
  derived and/or modified sequence opt5 from hemagglutinin__InfluenzaA__AFX96768
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccaucuccuggucuuacauuguggagaccagcuccucugacaacggcacgugcuauccgggggauuuuaucgacuacgaagaacugcgggagcagcuuagcuccgucagcucuuucgaacgcuuugagaucuuccccaagaccuccagcuggccuaaucacgauucuaacaagggagugacagccgcuuguccccaugccggcgcgaaauccuuuuauaagaaucugauuuggcucguuaaaaagggcaacagcuacccuaaacugucuaaguccuauaucaaugacaaggggaaagaagugcuuguccuguggggcauucaccaccccagcaccuccgccgaucaacagucucucuaccagaacgcugacgccuacguguucgugggaacaagcagauauuccaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggagcggaauuaucaucucugauacccccguccaugacugcaauacaaccugucaaaccccuaaaggcgccauuaacacaucccuccccuuccagaauauccacccgauuacgaucggcaagugcccuaaguaugugaaaagcaccaagcugagacuugcuacagggcugcggaacguucccucuauucagagccgcggacucuuuggcgccaucgccggguucaucgagggaggcuggaccgggaugguggacggaugguacggcuaucaucaccagaaugaacaaggcuccggguacgcugcggaucugaaaucuacacagaacgccauugacgagaucaccaauaaggucaacagcgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauuccaaugugaaaaaccuguacgagaagguccgcagccagcucaaaaacaaugccaaggaaaucgggaacggauguuuugaguucuaucacaagugcgacaauacauguauggaaucugugaaaaacggcaccuacgauuauccuaaguacuccgaggaagcuaaacugaauagagaggagaucgacgggguuaaacuugaaagcacaaagauuuaucaaauccuggccauuuacucuacgguggcguccagccucguccuggugguuucccugggcgcuaucucuuuuuggaugugcagcaacggaucccuccagugccggauuuguaucuga

SEQ ID NO: 192768 - RNA, 1701 nt, Artificial Sequence
  derived and/or modified sequence opt5 from hemagglutinin__InfluenzaA__AFX96778
augaaggccauccuggugauucuccuguacaccuucgcuacagccaacgcggacacgcuuugcaucggcuaucacgcuaauaacagcaccgauacagucgacaccauucuggagaagaauguuacagugacccauuccgugaaccuccuggaagauaagcacaaugggaaacuuuguaagcugagaggagucgcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuaucgacuacgaagaacugcgggagcagcuuuccagcguuucuuccuucgaacgcuuugagauuuuccccaagaccagcucuuggccuaaucacgauuccaacaagggagugacagccgcuuguccccaugccggcgcgaaaucuuuuuauaagaaucugaucuggcucgucaaaaagggcaacagcuacccuaaacuguccaagagcuauauuaaugacaaggggaaagaagugcuuguucuguggggaauccaccaccccuccaccucugccgaucaacagagccucuaccagaacgcugacgccuacguguucgucggcacauccagauauagcaagaaauuuaagccugagauugcuauccggccgaaagugcgcgaucaggaggggagaaugaauuacuauuggacccugguggaacccggagacaagauuacguucgaggccacaggcaaccuggucguuccucgguacgcguuugccauggaacgcaacgcugggucuggaaucaucauuuccgauacccccgugcaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguccccagcauccagucccgcggacucuuuggcgccaucgccggguucauugagggaggcuggaccgggaugguggacggaugguacggcuaucaucaccagaaugaacaaggcucuggguacgcugcggaucugaaaagcacacagaacgccaucgacgagauuaccaauaagguuaacuccgugaucgagaaaaugaauacgcaguuuacagcugucggaaaggaguucaaccaccuugagaagagaauugaaaaucugaacaaaaagguggaugacggcuuccucgauaucuggaccuacaaugccgagcugcugguucuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuauccuaaguacagcgaggaagcuaaacugaauagagaggagauugacggggucaaacuugaaucuacacggaucuaucaaauucuggccaucuacuccacgguggcgagcucccucguucugguggucucucugggcgcuauuagcuuuuggaugugcuccaacggaucucuccagugccgcaucuguauuuga

SEQ ID NO: 192769 - RNA, 1701 nt, Artificial Sequence
  derived and/or modified sequence opt5 from hemagglutinin__InfluenzaA__AFX96788
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaaaagaacgcugggucuggaaucauuaucuccgauacccccguccaugacugcaauacaaccugucaaaccccuaagggcgccaucaacacaagccuccccuuccagaauauucacccgaucacgauuggcaagugcccuaaauaugugaagucuaccaaacugcgccuugcuacagggcugagaaacguucccagcauccagucccggggacucuuuggcgccauugccggguucaucgagggaggcuggaccgggaugguggacggaugguacggcuaucaucaccagaaugaacaaggcucuggguacgcugcggaucuuaagagcacacagaacgccaucgacaaaauuaccaauaaggucaacuccgugaucgagaagaugaauacgcaguuuacagcuguuggaaaagaguucaaccaccuggaaaagcgcauugagaaucugaacaaaaagguggaugacggcuuccucgauaucuggaccuacaaugccgaacugcugguccuccuggagaacgaaagaacccuugacuaucaugauagcaaugugaaaaaccuguacgagaagguccggucucagcucaagaacaaugccaaagagauugggaacggauguuuugaguucuaucacaagugcgacaauacauguauggaguccgugaaaaacggcaccuacgauuauccuaaguacagcgaagaggcuaaacugaaucgcgaagagaucgacgggguuaaacuugagucuacaagaaucuaucaaauucuggccaucuacuccacgguggcgagcucccucguccuggugguuucucugggcgcuauuagcuuuuggaugugcuccaacggaucucuccagugccggaucuguauuuga

SEQ ID NO: 192770 - RNA, 1701 nt, Artificial Sequence; identical to SEQ ID NO: 192769
  derived and/or modified sequence opt5 from hemagglutinin__InfluenzaA__AFX96798

SEQ ID NO: 192771 - RNA, 1701 nt, Artificial Sequence; identical to SEQ ID NO: 186853
  derived and/or modified sequence opt5 from hemagglutinin__InfluenzaA__AFX96808

SEQ ID NO: 192772 - RNA, 1701 nt, Artificial Sequence; identical to SEQ ID NO: 189933
  derived and/or modified sequence opt5 from hemagglutinin__InfluenzaA__AFX96818

SEQ ID NO: 192773 - RNA, 1701 nt, Artificial Sequence; identical to SEQ ID NO: 192769
  derived and/or modified sequence opt5 from hemagglutinin__InfluenzaA__AFX96828

SEQ ID NO: 192774 - RNA, 1701 nt, Artificial Sequence; identical to SEQ ID NO: 188290
  derived and/or modified sequence opt5 from hemagglutinin__InfluenzaA__AFX96838

SEQ ID NO: 192775 - RNA, 1701 nt, Artificial Sequence
  derived and/or modified sequence opt5 from hemagglutinin__InfluenzaA__AFX96856
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguacccaugccggcgcgaaaucuuuuuauaagaaucugaucuggcucguuaaaaagggcaacagcuaccccaaacuguccaagagcuauauuaaugacaaggggaaagaagugcuuguccuguggggaauccaccacccuuccacaucugccgaucaacagagccucuaccagaacgcugacgccuacguguucgugggcaccuccagauauagcaagaaauuuaagcccgagauugcuauccggccuaaaguccgcgaucaggaggggagaaugaauuacuauuggacgcugguugaaccgggagacaagauuacauucgaggccaccggcaaccugguggugccccgguacgcguuugccauggaacgcaacgcugggucuggaaucauuaucuccgauacaccuguccaugacugcaauaccaccugucaaacacccaaaggcgccaucaacacgagccucccuuuccagaauauucaccccaucaccauuggcaagugcccgaaguaugugaaaucuacaaagcugagacuugcuaccgggcugcggaacguuccuagcauccagucccgcggacucuuuggcgccauugccggguucaucgagggaggcuggacagggaugguggacggaugguacggcuaucaucaccagaaugaacaaggcucuggguacgcugcggaucugaaaagcacccagaacgccaucgacgagauuacgaauaaggucaacuccgugaucgagaaaaugaauacacaguuuaccgcuguuggaaaggaguucaaccaccuugagaagagaauugaaaaucugaacaaaaagguggaugacggcuuccucgauaucuggaccuacaaugccgagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuaucccaaguacagcgaggaagcuaaacugaauagagaggagaucgacgggguuaaacuugaaucuacgcggaucuaucaaauucuggccaucuacuccaccguggcgagcucccucguccuggugguuucucugggcgcuauuagcuuuuggaugugcuccaacggaucucuccagugccgcaucuguauuuga

SEQ ID NO: 192776 - RNA, 1701 nt, Artificial Sequence; identical to SEQ ID NO: 192758
  derived and/or modified sequence opt5 from hemagglutinin__InfluenzaA__AFX96904

SEQ ID NO: 192777 - RNA, 1701 nt, Artificial Sequence; identical to SEQ ID NO: 187193
  derived and/or modified sequence opt5 from hemagglutinin__InfluenzaA__AFX96914

SEQ ID NO: 192778 - RNA, 1701 nt, Artificial Sequence
  derived and/or modified sequence opt5 from hemagglutinin__InfluenzaA__AFX96924
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagcgguuuaaaccugagauugcuauccgcccgaaggucagagaucaggaggggcggaugaauuacuauuggacccugguugaacccggagacaaaauuacguucgaggccacaggcaaccugguggugccucgcuacgcguuugccauggaaagaaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugcggcuugcuacagggcugcgcaacguucccagcauccaguccagaggacucuuuggcgccauugccggguucaucgagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagcggauugaaaaucugaacaagaaaguggaugacggcuuccucgauaucuggaccuacaaugccgagcugcugguccuccuggaaaacgagcgcacccuugacuaucaugauagcaaugugaagaaccuguacgagaaagucagaucucagcucaagaacaaugccaaagaaauugggaacggauguuuugaguucuaucacaagugcgacaauacauguauggaauccgugaagaacggcaccuacgauuauccuaaauacagcgaggaagcuaagcugaaucgggaggagaucgacgggguuaaacuugaaucuacacgcaucuaucaaauucuggccaucuacuccacgguggcgagcucccucguccuggugguuucucugggcgcuauuagcuuuuggaugugcuccaacggaucucuccagugcagaaucuguauuuga

SEQ ID NO: 192779 - RNA, 1701 nt, Artificial Sequence; identical to SEQ ID NO: 185693
  derived and/or modified sequence opt5 from hemagglutinin__InfluenzaA__AFX96934

SEQ ID NO: 192780 - RNA, 1701 nt, Artificial Sequence
  derived and/or modified sequence opt5 from hemagglutinin__InfluenzaA__AFY24097
augaaggccauccuggugguccuccuguacaccuucgcuacagccaacgcggacacgcuuugcauuggcuaucacgcugauaauagcaccgacacaguugauaccgugcuggagaagaacgugacagucacccauuccguggaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccuccacagaucaacagucucucuaccagaaugccgacgcuuacguguucgugggcaccagcagauauuccaagaaauuuaagccugagauugccauccggccgaaaguccgcgaucaggaggggagaaugaacuacuauuggacgcugguugaacccggagacaagauuacauucgaggcuaccggcaaucugguggugccucgguacgccuuugcgauggaacgcaacgccgggagcggaaucauuaucucugacacacccguccaugauugcaacaccaccugucaaacaccuaaaggcgcuaucaauacgucccuccccuuccagaacauucacccgaucaccauuggcaagugcccuaaguaugugaaaagcacaaagcugagacuugccaccgggcugcggaauguucccucuauccagagccgcggacucuuuggcgcuauugccggguucaucgagggaggcuggacagggaugguggacggaugguacggcuaucaucaccagaacgaacaaggcuccggguacgccgcugaucugaaaucuacccagaaugcgaucgacgagauuacgaacaaggucaauagcgugaucgagaaaaugaacacacaguuuaccgccguuggaaaggaguucaaucaccuugagaagagaauugaaaaccugaauaaaaagguggaugacggcuuccucgauaucuggaccuacaacgcugagcugcugguccuccuggaaaaugagcggacacuugacuaucaugauuccaacgugaaaaaucuguacgagaagguccgcagccagcucaaaaacaacgccaaggaaauugggaauggauguuuugaguucuaucacaagugcgacaacaccuguauggaaucugugaaaaauggcacauacgauuauccuaaguacuccgaggaagccaaacugaacagagaggagaucgacgggguuaaacuugaaagcacgcggaucuaucaaauucuggcuaucuacucuaccguggccuccagccucguccuggugguuucccugggcgcgauuucuuuuuggaugugcagcaauggaucccuccagugccgcaucuguauuuga

SEQ ID NO: 192781 - RNA, 1701 nt, Artificial Sequence; identical to SEQ ID NO: 183654
  derived and/or modified sequence opt5 from hemagglutinin__InfluenzaA__AFY24162

SEQ ID NO: 192782 - RNA, 1701 nt, Artificial Sequence
  derived and/or modified sequence opt5 from hemagglutinin__InfluenzaA__AFY24195
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcauuagaaauaucccuucucggaucagcauuuacuggaccaucgucaaacccggagauauucugcugaucaacuccaccggcaaucucauugcuccucgcggguacuucaagaucagaagcggaaagucuuccaucaugcggagcgacgcccccauuggcaaauguaacucugagugcaucacaccgaauggcagcauuccuaacgacaagcccuuucagaaugugaaccgcaucacguauggggcuuguccuagauacgugaaacagaauacccugaaacuugccacaggaaugcggaacguccccgaaaagcaaacccgcggcauuuucggggcgaucgccggauuuaucgagaauggcugggaagggaugguugauggaugguauggcuucagacaccagaacuccgagggcauugggcaggcugccgaccugaagucuacacaagcugccaucaaucagauuaacggaaaacucaaccggcugaucggcaagaccaaugagaaguuccaccagauugaaaaagaguuuagcgaaguggaggggagaauccaggaucuugaaaaguacguggaggacacgaaaauugaucugugguccuauaacgccgagcuccuggucgcucuggaaaaucaacauacaaucgaccucaccgauagcgagaugaacaagcuguucgaacgcaccaaaaagcagcuucgggagaaugcggaagacaugggaaacggcugcuuuaagaucuaccacaaaugugauaaugccugcauugggucuaucagaaacggcacauaugaccaugauguguaccgcgacgaggcucugaauaaccgguuccagauuaagggaguugagcucaaauccggcuacaaggacuggauccuguggauuagcuuugccaucucuugcuuccuucuguguguggcccuccugggguuuaucaugugggcuugccagaaaggaaauauuagauguaacaucugcauuuga

SEQ ID NO: 192783 - RNA, 1701 nt, Artificial Sequence; identical to SEQ ID NO: 183209
  derived and/or modified sequence opt5 from hemagglutinin__InfluenzaA__AFY24217

SEQ ID NO: 192784 - RNA, 1701 nt, Artificial Sequence
  derived and/or modified sequence opt5 from hemagglutinin__InfluenzaA__AGB08294
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacugauuaaguccuauaucaacgauaaggggaaagaagugcuuguccuguggggcauucaucaccccagcaccuccgccgaccagcagucucucuaccagaaugcugaugccuacguguucgugggaacaagcaaguauuccaaaaaguuuaaaccugagaucgcugucagaccgaagguucgggaccaagaggggcgcaugaacuacuauuggacccugguggaacccggagauaaaauuacguucgaggccacaggcaaccugcucgugccuagauacgcguuugucauggaacggaaugccgggagcggaaucauuaucucugacacccccgugcacgauugcaacacaaccugucagaccccuaagggcgcuaucaauacaucccugcccuuccagaacauucauccgaucacgauuggcaagugcccuaaauauguuaagagcaccaaacuucgccuggccacagggcucagaaauauccccucuauucagagccggggacuguuuggcgcuaucgccggguucaucgagggaggcuggaccgggaugguggacggaugguacggcuaucaccaucaaaacgcccagggcuccggguacgcugcggaccuuaagucuacacagaaugccauugauaaaaucaccaacaaggucaauagcgugauugaaaagaugaacacgcaguuuacagcuguuggaaaagaguucaaucaccuggagaagcgcaucgaaaaccucaauaaaaagguggacgauggcuuccuggacauuuggaccuacaacgccgagcugcucguccugcuugaaaaugagagaacccuggauuaucacgacuccaacgugaaaaaccucuacgaaaagguccggagccaacugaagaauaacgccaaagagaucgggaauggauguuuugaguucuaucauaagugcgauaacacauguauggaaucugugaaaaauggcaccuacgacuauccucgcuacuccgaggaagcuaaacuuaacagagaggaaaucgaugggguuaagcuggagagcacacggauuuaucagauccucgccauuuacucuacgguggcguccagccugguccuggugguuucccucggcgcuaucucuuuuuggaugugcagcaauggaucccugcagugccgcauuuguaucuga

SEQ ID NO: 192785 - RNA, 1701 nt, Artificial Sequence
  derived and/or modified sequence opt5 from hemagglutinin__InfluenzaA__AGB08295
augaaggccauccuggugguccuccuguacaccuucgcuacagccaacgcggacacgcuuugcauuggcuaucacgcuaauaacagcaccgauacaguugacaccgugaucgagaaaaaugugacagucacccauuccgugaaccugcucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucaauuacgaggagcuccgggagcagcuguccagcgucucuuccuucgaacgcuuugagaucuuccccaagaccagcucuuggccuaaccacgacuccaauaagggagugacagccgcuuguccccaugccggcgcgaaaucuuuuuauaagaaccuuauuuggcugguuaaaaagggcaauagcuacccuaaacucuccaagagcuauaucaacgauaagagaaaagaagugcugguccuuugggggauucaccaccccuccaccacagccgaccaacagucucuguaccagaaugcugaugccuacguguucgugggaaccagccgguauuccaagaaauuuaagccugagaucgcuauucgcccgaaagucagagaccaggagggccggaugaacuacuauuggacgcucguugaacccggggauaagaucacauucgaggccaccggaaaccugguggugccucgcuacgcguuugccauggaaagaacagcuggcagcgggauuaucaucucugacacccccguccaugauugcaauaccacaugucaaacgccuaaaggagccauuaacaccucccugcccuuccagaauauccacccgauuacaaucggcaagugcccuaaguaugugaaaagcaccaagcuccggcuggcuacaggccuucgcaacauucccucuauccagagcagagggcuguuuggagccaucgccggcuucauugaagggggauggaccggcaugguugacgggugguacggauaucaucaccagaaugaacaaggcuccggcuacgcugcggaccucaaaucuacgcagaacgccaucgauaagauuacaaauaaagugaacagcgucaucgagaagaugaauacccaguuuaccgcuguggggaaggaguucaaccaccuggaaaaacggauugagaaucuuaacaagaaaguugacgauggauuccuggacaucuggacauacaaugccgaacuccuggugcugcucgagaacgaacgcacccuggauuaucaugacuccaaugucaagaaccuuuacgagaaagugagaaaccagcugaagaauaacgccaaggagaucggcaauggguguuuugaguucuaucacaaaugcgauaacacauguauggaaagcgucaagaauggaacguacgacuauccuaaauacucugaagaggcuaagcucaaccgggaagagauugauggcgugaaacuggaguccacccgcaucuaucaaauucuugccaucuacagcacaguugcgucuucccuggugcucgucgugagccugggggcuauuuccuuuuggaugugcucuaauggcagccugcagugcagaaucuguauuuga

SEQ ID NO: 192786 - RNA, 1701 nt, Artificial Sequence
  derived and/or modified sequence opt5 from hemagglutinin__InfluenzaA__AGB08296
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgggcaggagggaagaaugaacuacuauuggacgcugguugaacccggcgacaagauuacauucgaggccaccgggaaccugguggugccucgguacgcguuugccauggaacgcacagcuggaagcggcaucauuaucucugauacccccguccaugacugcaauaccacaugucaaacgccuaaaggcgccaucaacaccucccuccccuuccagaauauucacccgaucacaauugggaagugcccuaaguaugugaaaagcaccaagcugagacuugcuacaggacugcggaacguucccucuauccagagccgcggccucuuuggggccauugccggauucaucgagggcggguggaccggaaugguggauggcugguacggcuaucaucaccagaaugaacaaggguccggauacgcugcggaccugaaaucuacgcagaacgccaucgacaagauuacaaauaaagucaacagcgugaucgagaagaugaauacccaguuuaccgcuguuggcaaggaguucaaccaccuugagaaaagaauugagaaucugaacaagaaaguggaugacggguuccucgauaucuggacauacaaugccgaacugcugguccuccuggagaacgaacggacccuugacuaucaugauuccaaugugaagaaccuguacgagaaaguccgcaaccagcucaagaauaacgccaaggagauuggaaauggcuguuuugaguucuaucacaaaugcgacaacacauguauggaaagcgugaagaaugggacguacgauuauccuaaauacucugaagaggcuaagcugaacagagaagagaucgacggcguuaaacuugaguccacccggaucuaucaaauucuggccaucuacagcacaguggcgucuucccucguccuggugguuagccugggagcuauuuccuuuuggaugugcucuaauggcagccuccagugccgcaucuguauuuga

SEQ ID NO: 192787 - RNA, 1701 nt, Artificial Sequence
  derived and/or modified sequence opt5 from hemagglutinin__InfluenzaA__AGB08297
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccgaaagcuauauuaacgauaaggggaaggaggugcuuguccuguggggaauccaccaccccuccaccacagccgaccaacagucucucuaccagaaugcugaugccuacguguucgugggcaccagcagauauuccaaaaaguuuaaaccugagauugcuauccggccgaagguccgcgaccaggaagggagaaugaacuacuauuggacgcugguugagcccggagauaaaauuacauucgaagccaccggcaaccugguggugccucgguacgcguuugccauggagcgcacagcugggagcggaaucauuaucucugacacccccguccaugauugcaauaccacaugucaaacgccuaagggcgccaucaacaccucccuccccuuccagaauauucacccgaucacaauuggcaaaugcccuaaguauguuaagagcaccaaacugagacuugcuacagggcugcggaacgugcccucuauccagagccgcggacucuuuggcgccauugccggguucaucgaaggaggcuggaccgggaugguggacggaugguacggcuaucaucaccagaaugagcaaggcuccggguacgcugcggaccugaagucuacgcagaacgccaucgauaaaauuacaaauaaggucaacagcgugaucgagaaaaugaauacccaguuuaccgcuguuggaaaggaguucaaccaccuugagaagagaauugaaaaucugaacaaaaagguggacgauggcuuccucgacaucuggacauacaaugccgagcugcugguccuccuggaaaacgagcggacccuugauuaucaugacuccaaugugaaaaaccuguacgagaagguccgcaaccagcucaaaaauaacgccaaggaaauugggaauggauguuuugaguucuaucacaagugcgauaacacauguauggaaagcgugaaaaauggcacguacgacuauccuaaguacucugaggaagcuaaacugaacagagaggagaucgaugggguuaaacuugaauccacccggaucuaucaaauucuggccaucuacagcacaguggcgucuucccucguccuggugguuagccugggcgcuauuuccuuuuggaugugcucuaauggaagccuccagugccgcaucuguauuuga

SEQ ID NO: 192788 - RNA, 1701 nt, Artificial Sequence
  derived and/or modified sequence opt5 from hemagglutinin__InfluenzaA__AGB08298
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaaucgcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucaauuacgaagaacugcgggagcagcuuuccagcgugucuuccuucgaacgcuuugagaucuuccccaagaccagcucuuggccuaaccacgacuccaauaagggagucacagccgcuuguccccaugccggcgcgaaaucuuuuuauaagaaccugauuuggcucgugaaaaagggcaauagcuacccuagacuguccaaaagcuauaucaacgauaaggggaaggaaguucuugugcuguggggcauucaccaccccuccaccacagccgaccaacagucucucuaccagaaugcugaugccuacgucuucgugggaaccagccgguauuccaaaaaguuuaaaccugagaucgcuauucgcccgaaggugagagaccaggaggggcggaugaacuacuauuggacgcuggucgaacccggagauaaaaucacauucgaggccaccggcaaccugguugugccucgcuacgcguuugccauggaaagaacagcugggagcggaauuaucaucucugacacccccgugcaugauugcaauaccacaugucaaacgccuaagggcgccauuaacaccucccuccccuuccagaauauccacccgauuacaaucggcaaaugcccuaaguaugucaagagcaccaaacugcggcuugcuacagggcugcgcaacgugcccucuauucagagcagaggacucuuuggcgccaucgccggguucaucgagggaggcuggaccgggaugguugacggaugguacggcuaucaucaccagaaugaacaaggcuccggguacgcugcggaccugaagucuacgcagaacgccauugauaaaaucacaaauaaggugaacagcgucauugagaaaaugaauacccaguuuaccgcugugggaaaggaguucaaccagcuugaaaagcggaucgagaaucugaacaaaaagguugacgauggcuuccucgacauuuggacauacaaugccgaacugcuggugcuccuggagaacgaacgcacccuugauuaucacgacuccaaugucaaaaaccuguacgagaaggugagaaaccaacucaaaaauaacgccaaggagaucgggaauggauguuuugaguucuaucauaagugcgauaacacauguauggagagcgucaaaaauggcacguacgacuauccuaaguacucugaagaggcuaaacugaaccgggaagagaucgauggggugaaacuugaguccacccgcauuuaucagauccuggccauuuacagcacaguugcgucuucccucgugcuggucgugagccugggcgcuaucuccuuuuggaugugcucuaauggaagccuccagugcagaauuuguaucuga

SEQ ID NO: 192789 - RNA, 1701 nt, Artificial Sequence
  derived and/or modified sequence opt5 from hemagglutinin__InfluenzaA__AGB08301
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaguggucaagcccggggauauucugcugaucaacuccaccggaaaucucauugccccucgcggcuacuucaaaaucagaagcgggaagucuuccauuaugcggagcgacgcucccaucggaaaauguaacucugccugcaucaccccgaauggcagcauuccuaacgacaagcccuuucagaauguuaaccgcaucacauacggcgcguguccuagauaugugaagcaaaauacgcugaaacuugccaccgggaugcggaacgugcccgagaagcagacacgcggaauuuucggcgcuaucgccggguuuauugaaaauggaugggagggcauggucgaugggugguacggauucagacaccagaacuccgagggccggggccaagcugccgaccugaaaucuacccaggccgcuaucgaucagaucaaugggaagcucaacagacugauuggaaaaacaaacgaaaaguuccaucagaucgagaaagaauuuagcgagguggaaggccgcauucaagaccuugagaaguauguugaggauaccaagaucgaccugugguccuacaaugcggaacuccugguggcccuggagaaccagcacacgauugaucucacagacagcgaaaugaauaaacuguucgagaagaccaaaaagcagcuucgggaaaacgcugaggauauggggaauggaugcuuuaaaaucuaucauaagugugacaacgccugcauuggcucuaucagaaaugggaccuacgaucacaacgucuaucgcgacgaggcccugaauaaccgguuccagaucaagggcguggaacucaaauccggauacaaggacuggauucuguggaucagcuuugcuauuucuugcuuccuucuguguguugcccuccugggcuuuaucaugugggcgugccaaaaagggaauauuagauguaacaucugcaucuga

SEQ ID NO: 192790 - RNA, 1701 nt, Artificial Sequence
  derived and/or modified sequence opt5 from hemagglutinin__InfluenzaA__AGB08343
augaagaccaucauugcccugagcuacaucuucugccucgugcuggcucaggaccuucccggcaacgauaauuccacagccacgcugugucucgggcaccaugcggucccuaacggaacccugguuaaaacaauuaccaaugaccaaaucgaggugacaaacgcuaccgaacuugugcagucuagcuccacaggcagaauuugcaauaacccgcaccggauccuggaugggaucaauuguacccucauugacgcccugcugggagauccccauugcgacggcuuucagaacaagaaaugggaucucuucgucgagcgcucuaaggccuuuagcaauuguuauccuuacgacgugcccgauuaugcuucccugagaucucuuguugccagcuccgggacgcuggaguucaucaacgaaggauuuaauuggaccggcgugacacagaacggcgggagcuacgcuugcaaacggggaccugacaauggcuucuuuucucgccucaacuggcuguauaaguccgaaagcaccuaccccguccuuaaugugacaaugccuaacaacgauaauuucgacaagcuguauauuuggggaguucaccauccgucuaccgauaaagagcaaacgaaccucuacgugcaggccuccgggagagucacagugagcaccaagcggucucagcagacaaucauucccaaugugggcucccgcccuugggucagagggcugagcucccggaucucuauuuacuggaccaucguuaaacccggagacauccuggugauuaacagcaauggcaaccucaucgcgccucgcggcuauuuuaagauuagaaaugggaaauccagcaucaugcggucugacgcccccauuggaaccuguuccagcgagugcaucacaccgaacggcucuaucccuaaugauaagcccuuccaaaacgugaauaagauuacguacggggcuuguccuaaauaugucaagcagaacacccugaaacuugccacaggaaugcgcaaugugcccgaaaagcagaccagaggcaucuuuggggcuauugccggauucaucgagaacggcugggaaggcaugauugacgggugguacggauuucggcaccagaauagcgagggcacagggcaagcggccgaucugaaauccacccaggcugccaucgaccagaucaacggaaagcucaaccgcguuauugagaaaacgaaugaaaaguuccaccaaaucgagaaggaguucucugaaguggaaggccggauucaggaucuggagaaauaugucgaggacacaaagaucgaucuuuggagcuacaacgcugaacugcucguggcccuggagaaucagcauaccauugaccugaccgauuccgaaaugaacaaacucuuugagaagacaagaagacagcugcgcgaaaaugccgaggacauggggaacggcugcuucaaaaucuaucacaagugugauaaugcuugcauuggaagcauccggaacggcaccuacgaccaugacguuuacagagaugaggcgcuuaauaaccgcuuucaaaucaaggggguggaacugaaaucuggauauaaggacuggauucucuggaucuccuucgccauuagcugcuuucugcuuugugucgugcugcucggcuucaucaugugggcuugccagaaagggaauauucgguguaacaucugcaucuga

SEQ ID NO: 192791 - RNA, 1701 nt, Artificial Sequence
  derived and/or modified sequence opt5 from hemagglutinin__InfluenzaA__AGB08362
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucaacuguacccucauugaugcccugcugggcgacccccauugcgauguguuucaggacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaacaagcuguuugauaaaacacggagacaacuucgcgagaacgccgaagacaugggcaauggaugcuucaagauuuaucacaaaugugacaacgcuugcaucgagucuauucggaauggcaccuacgaucaugacguuuauagagaugaggcgcugaacaaucgcuuucagaucaaggggguggaacucaaauccggauacaaggacuggauccuguggauuagcuucgccaucucuugcuuucuucugugugucgugcuccugggcuucauuaugugggcuugccagcgggggaacaucagauguaauauuugcaucuga

SEQ ID NO: 192792 - RNA, 1701 nt, Artificial Sequence; identical to SEQ ID NO: 189846
  derived and/or modified sequence opt5 from hemagglutinin__InfluenzaA__AGB12986

SEQ ID NO: 192793 - RNA, 1701 nt, Artificial Sequence; identical to SEQ ID NO: 190110
  derived and/or modified sequence opt5 from hemagglutinin__InfluenzaA__AGB13006

SEQ ID NO: 192794 - RNA, 1701 nt, Artificial Sequence
  derived and/or modified sequence opt5 from hemagglutinin__InfluenzaA__AGB13016
augaaggccauccuggugguccuccuguacaccauugcuacagccaacgcggacacgcuuugcaucggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuucaucaauuacgaggaacugcgggagcagcuuuccagcgucucuuccuuugaacgcuucgagaucuuucccaagaccagcucuuggccuaaccacgacuccaauaagggagugacagccgcuuguccccaugccggcgcgaaaucuuucuauaagaaccugauuuggcucguuaaaaagggcaauagcuacccuaaacuguccaagagcuauaucaacgauaaggggaaagaagugcuuguccuguggggcauucaccaccccuccaccacagccgaccaacagucucucuaccagaaugcugaugccuacguguuugugggaaccagcagauauuccaagaaauucaagccugagaucgcuauucggccgaaaguccgcgaccaggaggggagaaugaacuacuauuggacgcugguugaacccggagauaagaucacauuugaggccauuggcaaccugguggugccucgguacgcguucgccauggaaaagaaugcugggagcggaaucaucauuucugacacccccguccaugauugcaacacaaccugucaaaccccuaagggcgccaucaauacaucccuccccuuucagaacauucacccgaucacgauuggcaagugcccuaaauauguuaagagcaccaaacugcgccuugcuacagggcugagaaaugugcccucuauccagagccggggacucuucggcgccaucgccggguuuauugagggaggcuggaccgggaugguggacggaugguacggcuaucaucaccagaacgaacaaggcuccggguacgcugcggaccugaagucuacacagaaugccaucgauaaaauuaccaacaaggucaauagcgugaucgagaagaugaacacgcaguucacagcuguuggaaaagaguuuaaucaccuugaaaagcgcauugagaaccugaauaaaaagguggacgauggcuuccucgacaucuggaccuacaacgccgaacugcugguccuccuggagaaugaaagaacccuugauuaucaugacuccaacgugaaaaaccuguacgagaagguccggaaucagcucaagaacaaugccaaagagaucgggaacggauguuucgaauuuuaucacaagugcgauaauacauguauggagagcgugaaaaacggcaccuacgacuauccuaaguacucugaagaggcuaaacugaaucgcgaagagauugaugggguuaaacuugaguccgccagaguguaucaaauccuggcgauuuacagcacagucgcuucuucccucgugcugguugugagccugggcgccaucuccuucuggaugugcucuaacggaagccuccagugccggauuuguaucuga

SEQ ID NO: 192795 - RNA, 1701 nt, Artificial Sequence; identical to SEQ ID NO: 189891
  derived and/or modified sequence opt5 from hemagglutinin__InfluenzaA__AGB13026

SEQ ID NO: 192796 - RNA, 1701 nt, Artificial Sequence; identical to SEQ ID NO: 189833
  derived and/or modified sequence opt5 from hemagglutinin__InfluenzaA__AGB13036

SEQ ID NO: 192797 - RNA, 1701 nt, Artificial Sequence
  derived and/or modified sequence opt5 from hemagglutinin__InfluenzaA__AGB13048
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcgauaauaccuguaucgaaagcgugaagaacggcacauacgacuauccuaaauacucugaagaggcuaagcugaauagagaagagaucgaugggguuaaacuugaguccacgcggauuuaucaaauccuggccauuuacagcaccguggcgucuucccucguccuggugguuagccugggcgcuaucuccuuuuggaugugcucuaacggaagccuccagugccgcauuuguaucuga

SEQ ID NO: 192798 - RNA, 1701 nt, Artificial Sequence
  derived and/or modified sequence opt5 from hemagglutinin__InfluenzaA__AGB13066
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaagggaccaagcugagacuugcuacaggacugcggaacguucccucuauccagagccgcggccucuuuggggccauugccggauucaucgagggcggguggaccggaaugguggacggcugguacggcuaucaucaccagaaugaacaaggguccggauacgcugcggaucugaaaucuacacagcacgccaucgacgagauuaccaacaaggucaauagcgugaucgagaaaaugaacacgcaguuuacagcuguuggcaaggaguucaaucaucuugagaagagaauugaaaaccugaauaaaaagguggaugacggguuccucgauaucuggaccuacaacgccgagcugcugguccuccuggaaaaugagcggacccuugacuaucacgauuccaacgugaaaaaucuguacgagaagguccgcagccagcucaaaaacaacgccaaggaaauuggaaauggcuguuuugaguucuaucauaagugcgacaacacauguauggaaucugugaaaaaugggaccuacgauuauccuaaguacuccgaggaagcuaaacugaacagagaggagaucgacggcguuaaacuugaaagcacacggaucuaucaaauucuggccaucuacucuacgguggcguccagccucguccuggugguuucccugggagcuauuucuuuuuggaugugcagcaauggcucccuccagugccgcaucuguauuuga

SEQ ID NO: 192799 - RNA, 1701 nt, Artificial Sequence; identical to SEQ ID NO: 189933
  derived and/or modified sequence opt5 from hemagglutinin__InfluenzaA__AGB13082

SEQ ID NO: 192800 - RNA, 1701 nt, Artificial Sequence; identical to SEQ ID NO: 189833
  derived and/or modified sequence opt5 from hemagglutinin__InfluenzaA__AGB13105

SEQ ID NO: 192801 - RNA, 1701 nt, Artificial Sequence; identical to SEQ ID NO: 189891
  derived and/or modified sequence opt5 from hemagglutinin__InfluenzaA__AGB13125

SEQ ID NO: 192802 - RNA, 1701 nt, Artificial Sequence; identical to SEQ ID NO: 189891
  derived and/or modified sequence opt5 from hemagglutinin__InfluenzaA__AGB13130

SEQ ID NO: 192803 - RNA, 1701 nt, Artificial Sequence
  derived and/or modified sequence opt5 from hemagglutinin__InfluenzaA__AGB13140
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccucccuguggucuuacaucguggagaccagcuccucugacaacggcacgugcuauccgggggauuuuauugacuacgaagaacuucgggagcagcugagcuccgucagcucuuucgaacgcuuugagaucuuccccaagaccuccagcuggccuaaucacgauucuaacaagggagugacagccgcuuguccccaugccggcgcgaaauccuuuuauaagaaucucaucuggcugguuaaaaagggcaacagcuacccuaaacuuucuaaguccuauauuaaugacaaggggaaagaagugcugguccucuggggaauccaccaccccagcaccacagccgaucaacagucccuguaccagaacgcugacaccuacguguucgugggcacgucuagauauagcaagaaauuuaagccugagauugccauccggccgaaaguccgcgaucaggaggggagaaugaauuacuauuggacacugguugaacccggagacaagauuaccuucgaggcuacaggcaaccucguggugccucgguacgccuuugcgauggaacgcaacgccggguccggaaucauuaucagcgauacccccguccaugacugcaauaccacaugucaaacgccuaaaggcgcuaucaacaccucucugcccuuccagaauauucacccgaucacaauuggcaagugcccuaaguaugugaaauccaccaaacuuagacuggccacagggcuccggaacguucccagcauccagucucgcggacuguuuggcgcuauugccggguucaucgagggaggcuggaccgggaugguggacggaugguacggcuaucaucaccagaaugaacaaggcagcggguacgccgcugaucuuaaauccacgcagaacgcgaucgacaagauuacaaauaaagucaacucugugaucgagaagaugaauacccaguuuaccgccguuggaaaggaguucaaccaccuggaaaagagaauugagaaucucaacaagaaaguggaugacggcuuccuggauaucuggacauacaaugcugaacugcucguccugcuugagaacgaacggacccuggacuaucaugauagcaaugugaagaaccucuacgagaaaguccgcaaccagcugaagaauaacgccaaggagauugggaauggauguuuugaguucuaucacaaaugcgacaacacauguauggaguccgugaagaauggcacguacgauuauccuaaauacagcgaagaggccaaacuuaacagagaagagaucgacgggguuaagcuggagucuacccggaucuaucaaauucucgcuaucuacuccacaguggccagcucucugguccuggugguuucccucggcgcgauuagcuuuuggaugugcuccaauggaucucugcagugccgcaucuguauuuga

SEQ ID NO: 192804 - RNA, 1701 nt, Artificial Sequence
  derived and/or modified sequence opt5 from hemagglutinin__InfluenzaA__AGB13159
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugccucucugcaucucggcaaaugcaacaucgccggguggauucugggaaaucccgagugugaaagccuguccacagcuucuagcugguccuacaucguggagaccucuagcuccgacaacggcacgugcuauccuggggauuuuauugacuacgaagaacuccgggagcagcugagcucugucuccagcuucgaacgcuuugagaucuucccgaagaccucuuccuggcccaaucacgauagcaacaagggagugacagccgcuuguccucaugccggcgcgaaaggcuuuuauaagaaucuuaucuggcugguuaaaaaggggaacucuuaccccaaacucuccaagagcuauauuaaugacaagggaaaagaagugcugguccuuuggggcauccaccacccuuccaccacagccgaucaacagucucuguaccagaacgcugacaccuacguguucguggggacgagcagauauuccaagaaauuuaagcccgagauugccauccggccuaaaguccgcgaucaggagggaagaaugaauuacuauuggacacucguugaaccgggcgacaagauuaccuucgaggcuacagggaaccugguggugccccgguacgccuuugcgauggaacgcaacgccggaagcggcaucauuaucucugauaccccuguccaugacugcaauaccacaugucaaacgcccaaaggcgcuaucaacaccucccugccuuuccagaauauucaccccaucacaauugggaagugcccgaaguaugugaaaagcaccaagcucagacuggccacaggacuucggaacguuccuucuauccagagccgcggccuguuuggggcuauugccggauucaucgagggcggguggaccggaaugguggacggcugguacggcuaucaucaccagaaugaacaaggguccggauacgccgcugaucucaaaucuacgcagaacgcgaucgacaagauuacaaauaaagucaacagcgugaucgagaagaugaauacccaguuuaccgccguuggcaaggaguucaaccaccuggaaaagagaauugagaaucuuaacaagaaaguggaugacggguuccuggauaucuggacauacaaugcugaacuccugguccugcucgagaacgaacggacccuggacuaucaugauuccaaugugaagaaccuuuacgagaaaguccgcaaccagcugaagaauaacgccaaggagauuggaaauggcuguuuugaguucuaucacaaaugcgacaacacauguauggagagcgugaagaaugggacguacgauuaucccaaauacucugaagaggccaagcucaacagagaagagaucgacggcguuaaacuggaguccacccggaucuaucaaauucuugcuaucuacagcacaguggccucuucccugguccucgugguuagccugggagcgauuuccuuuuggaugugcucuaauggcagccugcagugccgcaucuguauuuga

SEQ ID NO: 192805 - RNA, 1701 nt, Artificial Sequence; identical to SEQ ID NO: 189848
  derived and/or modified sequence opt5 from hemagglutinin__InfluenzaA__AGB13170

SEQ ID NO: 192806 - RNA, 1701 nt, Artificial Sequence
  derived and/or modified sequence opt5 from hemagglutinin__InfluenzaA__AGB13180
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacauccguccaugauugcaacaccaccugucaaacacccaaaggcgccaucaauacgagccucccuuuccagaacauucaccccaucaccauuggcaagugcccgaaguaugugaaaucuacaaagcugagacuugcuaccgggcugcggaauguuccuagcauccagucccgcggacucuuuggcgccauugccggguucaucgagggaggcuggacagggaugguggacggaugguacggcuaucaucaccagaacgaacaaggcucuggguacgcugcggaccugaaaagcacccagaaugccaucgauaagauuacgaacaaagucaauuccgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacagcaacgugaagaaccuguacgagaaaguccgcaaucagcucaagaacaaugccaaggagauugggaacggauguuuugaguucuaucacaaaugcgauaauaccuguauggaaucugugaagaacggcacauacgacuaucccaaauacuccgaagaggcuaagcugaauagagaagagaucgaugggguuaaacuugagagcacgcggaucuaucaaauucuggccaucuacucuaccguggcguccagccucguccuggugguuucccugggcgcuauuucuuuuuggaugugcagcaacggaucccuccagugccgcaucuguauuuga

SEQ ID NO: 192807 - RNA, 1701 nt, Artificial Sequence; identical to SEQ ID NO: 189891
  derived and/or modified sequence opt5 from hemagglutinin__InfluenzaA__AGB13190

SEQ ID NO: 192808 - RNA, 1701 nt, Artificial Sequence
  derived and/or modified sequence opt5 from hemagglutinin__InfluenzaA__AGB13200
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcguuaagagcuuuuauaagaaccugaucuggcucgugaaaaagggcaauucuuacccuaaacuguccaagagcuauauuaacgauaaggggaaagaaguccuugugcuguggggaauccaccaccccuccaccacaaccgaccaacagucucucuaccagaaugcggaugccuacguguucgucggcacgagcaaguauuccaaaaaguuuaaaccugagauugcuaucagaccgaagguucgggaccaggaggggcgcaugaacuacuauuggacacugguggaacccggagauaaaauuaccuucgaggccacaggcaaccugguggucccuagauacgcuuuugccauggaacggaaugcggggagcggaaucauuaucucugacacccccgugcaugauugcaacaccacaugucaaacgccuaagggcgccaucaauaccucccuccccuuccagaacauucacccgaucacaauuggcaagugcccuaaauauguuaagagcaccaaacugcgccuugcuacagggcugagaaaugugcccucuauccagagccggggacucuuuggcgccauugcuggguucaucgagggaggcuggaccgggauggucgacggaugguacggcuaucaucaccagaacgaacaaggcuccggguacgccgccgaccugaagucuacgcagaaugcuaucgauaaaauuacaaacaaggugaauagcguuaucgagaagaugaacacccaguuuaccgcggugggaaaagaguucaaucaccuugaaaagcgcauugagaaccugaauaaaaaggucgacgauggcuuccucgacaucuggacauacaacgccgaacugcuggugcuccuggagaaugaaagaacccuugauuaucaugacuccaacgucaaaaaccuguacgagaaggugcggaaucagcucaagaacaaugcuaaagagauugggaacggauguuuugaguucuaucacaagugcgauaauacauguauggagagcguuaaaaacggcacguacgacuauccuaaguacucugaagaggccaaacugaaucgcgaagagaucgauggggugaaacuugaguccaccagaaucuaucaaauucuggccaucuacagcacagucgcuucuucccucgugcugguugugagccugggcgccauuuccuuuuggaugugcucuaacggaagccuccagugccggaucuguauuuga

SEQ ID NO: 192809 - RNA, 1701 nt, Artificial Sequence
  derived and/or modified sequence opt5 from hemagglutinin__InfluenzaA__AGB13210
augaaggccacccuggugguccuccuguacacauucgcuacggccaacgcggacacccuuugcaucggcuaucacgcuaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucaauuacgaagaacugcgggagcagcuuuccagcgucucuuccuucgaacgcuuugagauuuuccccaagacaagcucuuggccuaaccacgacuccaauaagggagugaccgccgcuuguccccaugccggcgcgaaaucuuuuuauaagaaccugaucuggcucguuaaaaagggcaauagcuacccuaaacuguccaagagcuauaucaacgauaaggggaaagaagugcuuguccuguggggcauucaccaccccuccacaucugccgaccaacagagccucuaccagaaugcugaugccuacguguucgugggcaccuccaaguauagcaaaaaguuuaaaccugagaucgcugucagaccgaagguucgggaccaggaggggcgcaugaacuacuauuggacgcugguggaacccggagauaaaauuacauucgaggccaccggcaaccugcucgugccuagauacgcguuugccauggaacggaaugcugggucuggaaucauuaucuccgacacacccguccaugauugcaacaccaccugucaaacaccuaagggcgccauuaauacgagccugcccuuccagaacauccacccgaucaccauuggcaagugcccuaaauaugugaagucuacaaaacuucgccuggcuaccgggcucagaaauguucccagcauccagucccggggacuguuuggcgccauugccggguucaucgagggaggcuggacagggaugguggacggaugguacggcuaucaucaccagaacgaacaaggcucuggguacgcugcggaccuuaagagcacccagaaugccauugauaaaaucacgaacaaggucaauuccgugaucgagaagaugaacacacaguuuaccgcuguuggaaaagaguucaaucaccuggaaaagcgcauugagaaccucaauaaaaagguggacgauggcuuccuggacaucuggaccuacaacgccgaacugcucguccugcuugagaaugaaagaacacuggauuaucaugacagcaacgugaaaaaccucuacgagaagguccggucucagcugaagaauaacgccaaagagauugggaauggauguuuugaguucuaucacaagugcgauaacaccuguauggaguccgugaaaaauggcacauacgacuauccuaaguacagcgaagaggcuaaacuuaaccgcgaagagaucgaugggguuaagcuggagucuacgagaauuuaucaaauccucgccaucuacuccaccguggcgagcucccugguccuggugguuucucucggcgcuauuagcuuuuggaugugcuccaauggaucucugcagugccggaucuguauuuga

SEQ ID NO: 192810 - RNA, 1701 nt, Artificial Sequence
  derived and/or modified sequence opt5 from hemagglutinin__InfluenzaA__AGB13220
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccauuucugacaacggcacgugcuauccgggggauuuuaucaauuacgaagaacugcgggagcagcuuagcuccgucagcucuuucgaacgcuuugagaucuuccccaagaccuccagcuggccuaaccacgacucuaauaagggagugacagccgcuuguccccaugccggcgcgaaauccuuuuauaagaaccugauuuggcucguuaaaaagggcaauagcuacccuaaacugucuaaguccuauaucaacgauaaggggaaagaagugcuuguccuguggggcauucaccaccccagcaccacagccgaccaacagucccucuaccagaaugcugaugccuacguguucgugggaaccucuaaguauagcaaaaaguuuaaaccugagaucgcuauuagaccgaagguccgggaccaggaggggcgcaugaacuacuauuggacgcugguugaacccggagauaaaaucacauucgaggccaccggcaaccugguggugccuagauacgcguuugccauggaacggaaugcuggguccggaauuaucaucagcgacacacccguccaugauugcaacaccaccugucaaacaccuaagggcgccauuaauacgucucuccccuuccagaacauccacccgauuaccaucggcaagugcccuaaauaugugaaguccacaaaacugcgccuugcuaccgggcugagaaauguucccagcauucagucucggggacucuuuggcgccaucgccggguucaucgagggaggcuggacagggaugguggacggaugguacggcuaucaucaccagaacgaacaaggcagcggguacgcugcggaccugaaguccacccagaaugccauugauaaaaucacgaacaaggucaauucugugauugagaagaugaacacacaguuuaccgcuguuggaaaagaguucaaucaccuugaaaagcgcaucgagaaccugaauaaaaagguggacgauggcuuccucgacauuuggaccuacaacgccgaacugcugguccuccuggagaaugaaagaacacuugauuaucaugacagcaacgugaaaaaccuguacgagaagguccggaaucagcucaagaacaaugccaaagagaucgggaacggauguuuugaguucuaucacaagugcgauaauaccuguauggaguccgugaaaaacggcacauacgacuauccuaaguacagcgaagaggcuaaacugaaucgcgaagagaucgaugggguuaaacuugagucuacgagaauuuaucaaauccuggccauuuacuccaccguggcgagcucucucguccuggugguuucccugggcgcuaucagcuuuuggaugugcuccaacggaucucuccagugccggauuuguaucuga

SEQ ID NO: 192811 - RNA, 1701 nt, Artificial Sequence
  derived and/or modified sequence opt5 from hemagglutinin__InfluenzaA__AGB13230
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaaucacaacgggaaacuuuguaagcugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaaaaccagcucuuggccuaaucacgacuccaacaagggagugacagccgcuuguccccaugccggcgccaagagcuuuuauaaaaaucugaucuggcucguuaagaaaggcaacucuuacccuaagcuguccaaaagcuauauuaaugauaaggggaaggaagugcuuguccuguggggaauccaccaccccuccaccacagccgaccaacagucucucuaccagaacgcugaugccuacguguucgugggcaccagcagauauuccaaaaaguuuaaaccugagauugcuauccggccgaagguccgcgaccaggaggggagaaugaacuacuauuggacgcugguugaacccggagauaaaauuacauucgaggccaccggcaaucugguggugccucgguacgcguuugccauggaacgcaacgcugggagcggaaucauuaucucugacacacccguccaugauugcaauaccaccugucaaacaccuaagggcgccaucaacacgucccuccccuuccagaauauucacccgaucaccauuggcaaaugcccuaaguauguuaagagcacaaaacugagacuugcuaccgggcugcggaacgugcccucuauccagagccgcggacucuuuggcgccauugccggguucaucgagggaggcuggacagggaugguggacggaugguacggcuaucaucaccagaaugaacaaggcuccggguacgcugcggaccugaagucuacccagaacgccaucgauaaaauuacgaauaaggucaacagcgugaucgagaaaaugaauacacaguuuaccgcuguuggaaaggaguucaacagacuugaaaagcggauugagaaucugaacaaaaagguggacgauggcuuccucgacaucuggaccuacaaugccgaacugcugguccuccuggagaacgaacgcacacuugauuaucacgacuccaacgugaaaaaucuguacgagaaggucagaaaccagcucaaaaauaacgccaaggagauugggaauggauguuuugaguucuaucauaagugcgauaacaccuguauggagagcgugaaaaauggcacauacgacuauccuaaguacucugaagaggcuaaacugaaccgggaagagaucgaugggguuaaacuugaguccacgcgcaucuaucaaauucuggccaucuacagcaccguggcgucuucccucguccuggugguuagccugggcgcuauuuccuuuuggaugugcucuaauggaagccuccagugcagaaucuguauuuga

SEQ ID NO: 192812 - RNA, 1701 nt, Artificial Sequence; identical to SEQ ID NO: 189891
  derived and/or modified sequence opt5 from hemagglutinin__InfluenzaA__AGB13240

SEQ ID NO: 192813 - RNA, 1701 nt, Artificial Sequence; identical to SEQ ID NO: 189891
  derived and/or modified sequence opt5 from hemagglutinin__InfluenzaA__AGB13250

SEQ ID NO: 192814 - RNA, 1701 nt, Artificial Sequence
  derived and/or modified sequence opt5 from hemagglutinin__InfluenzaA__AGB13260
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcagcaaaucuuuuuauaagaaucugaucuggcucguuaaaaagggcaacuccuacccuaaacugagcaaguccuauauuaaugacaaggggaaagaagugcuuguccuguggggaauccaccaucccccuacaucugccgaucaacagagccucuaccagaacgcggacgccuacguguucgugggcaccuccagauauagcaagaaauuuaagccggagauugcuauccggcccaaaguccgcgaucaggaggggagaaugaauuacuauuggacgcugguugaaccuggagacaagauuacauucgaggccaccggcaaccugguggugccccgguacgcuuuugccauggaacgcaacgcggggucuggaaucauuaucuccgauacaccuguccacgacugcaauaccaccugucaaacacccaaaggcgccaucaacacgagccucccguuccagaaugugcacccuauuaccaucggcaagugccccaaguauguuaaaucuacaaagcugagacuugcuaccgggcugcggaacgugccuagcauucagucccgcggacucuuuggcgccaucgcuggguucauugagggaggcuggacagggauggucgacggaugguacggcuaucaucaccagaaugaacaaggcucuggguacgccgccgaucugaaaagcacccagaacgcuaucgacgagaucacgaauaaggugaacuccguuauugagaaaaugaauacacaguuuaccgcggugggaaaggaguucaaccaccuugagaagagaaucgaaaaucugaacaaaaaggucgaugacggcuuccucgauauuuggaccuacaaugccgagcugcuggugcuccuggaaaacgagcggacacuugacuaucaugauagcaaugucaaaaaccuguacgagaaggugcgcucucagcucaaaaacaaugcuaaggaaaucgggaacggauguuuugaguucuaucacaagugcgacaauaccuguauggaauccauuaaaaacggcacauacgauuaucccaaguacagcgaggaagccaaacugaauagagaggagaucgacgggguuaaacuugaaucuacgcggaucuaucaaauucuggccaucuacuccaccguggcuagcucccucguccuggugguuucucugggcgccauuagcuuuuggaugugcuccaacggaucucuccagugccgcaucuguauuuga

SEQ ID NO: 192815 - RNA, 1701 nt, Artificial Sequence
  derived and/or modified sequence opt5 from hemagglutinin__InfluenzaA__AGB13270
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaucaccagaacgaacaaggcucuggguacgcugcggaccuuaagagcacacagaaugccaucgauaaaaucaccaacaaggucaauuccgugauugagaagaugaacacgcaguuuacagcuguuggaaaagaguucaaucaccuggaaaagcgcaucgagaaccucaauaaaaagguggacgauggcuuccuggacauuuggaccuacaacgccgaacugcucguccugcuugagaaugaaagaacccuggauuaucaugacagcaacgugaaaaaccucuacgagaagguccggucucagcugaagaauaacgccaaagagaucgggaauggauguuuugaguucuaucacaagugcgauaacacauguauggaguccgugaaaaauggcaccuacgacuauccuaaguacagcgaagaggcuaaacuuaaccgcgaaaagauugaugggguuaagcuggagucuacaagaaucuaucaaauccucgccauuuacuccacgguggcgagcucccugguccuggugguuucucucggcgcuaucagcuuuuggaugugcuccaauggaucucugcagugccggauuuguaucuga

SEQ ID NO: 192816 - RNA, 1701 nt, Artificial Sequence
  derived and/or modified sequence opt5 from hemagglutinin__InfluenzaA__AGB13280
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccaaugccgaccaacagucucucuaccagaacgcugaugccuacguguucgugggcacaagcaaguauuccaaaaaguuuaaaccugagauugcugucagaccgaagguucgggaccaggaggggcgcaugaacuacuauuggacccugguggaacccggagauaaaaucacguucgaggccacaggcaaucugcucgugccuagauacgcguuugccauggaacggaacgcugggagcggaauuaucauuucugacacccccguccaugauugcaauacaaccugucaaaccccuaagggcgccaucaacacaucccugcccuuccagaauauccacccgauuacgaucggcaagugcccuaaauauguuaagagcaccaaacuucgccuggcuacagggcucagaaacgugcccucuauucagagccggggacuguuuggcgccaucgccggguucauugagggaggcuggaccgggaugguggacggaugguacggcuaucaucaccagaauggccaaggguccggauacgcugcggaccuuaagucuacacagaacgccaucgauaaaaucaccaauaaggucaacagcgugauugaaaagaugaauacgcaguuuacagcuguuggcaaagaguucaaccaccuggagaagcgcaucgaaaaucucaacaaaaagguggacgauggguuccuggacauuuggaccuacaaugccgagcugcucguccugcuugaaaacgagagaacccuggauuaucaugacuccaacgugaaaaaucucuacgaaaagguccggagccagcugaagaacaaugccaaagagaucggaaacggcuguuuugaguucuaucacaagugcgauaauacauguauggaaucugugaaaaacgggaccuacgacuauccuaaguacuccgaggaagcuaaacuuaaucgcgaggaaauugauggcguuaagcuggagagcacaagaaucuaucaaauccucgccauuuacucuacgguggcguccagccugguccuggugguuucccucggagcuaucucuuuuuggaugugcagcaacggcucccugcagugccggauuuguaucuga

SEQ ID NO: 192817 - RNA, 1701 nt, Artificial Sequence
  derived and/or modified sequence opt5 from hemagglutinin__InfluenzaA__AGB13290
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaaguuaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgauaacggcacgugcuauccgggggacuuuauuaauuacgaagaacugcgggagcagcuuuccagcgugucuuccuucgaacgcuuugagaucuuccccaagaccagcucuuggccuaaccacgauuccaauaagggaguuacagccgcuuguccccaugccggcgcgaaaucuuuuuauaagaaccugaucuggcucgugaaaaagggcaauagcuacccuaaacuguccaagagcuauauuaacgacaaggggaaagaaguccuugugcuguggggaauccaccaccccuccaccacagccgaucaacagucucucuaccagaaugcugacgccuacguguucgucggcaccagcagauauuccaagaaauuuaagccugagauugcuauccggccgaaaguucgcgaucaggaggggagaaugaacuacuauuggacgcugguggaacccggagacaagauuacauucgaggccaccggcaaccugguggucccucgguacgcguuugccauggaacgcaaugcugggagcggaaucauuaucucugauacacccgugcaugacugcaacaccaccugucaaacaccuaaaggcgccaucaauacgucccuccccuuccagaacauucacccgaucaccauuggcaagugcccuaaguauguuaaaagcacaaagcugagacuugcuaccgggcugcggaaugugcccucuauccagagccgcggacucuuuggcgccauugccggguucaucgagggaggcuggacagggauggucgauggaugguacggcuaucaucaccagaacgaacaaggcuccggguacgcugcggaccugaaaucuacccagaaugccaucgacaagauuacgaacaaagugaauagcguuaucgagaagaugaacacacaguuuaccgcugugggaaaggaguucaaucaccuugagaaaagaauugagaaccugaauaagaaagucgaugacggcuuccucgauaucuggaccuacaacgccgaacugcuggugcuccuggagaaugaacggacacuugacuaucaugauuccaacgucaagaaccuguacgagaaagugcgcaaucagcucaagaacaaugccaaggagauugggaacggauguuuugaguucuaucacaaaugcgacaauaccuguauggaaagcguuaagaacggcacauacgauuauccuaaauacucugaagaggcuaagcugaauagagaagagaucgacggggugaaacuugaguccacgcggaucuaucaaauucuggccaucuacagcaccgucgcgucuucccucgugcugguugugagccugggcgcuauuuccuuuuggaugugcucuaacggaagccuccagugccgcaucuguauuuga

SEQ ID NO: 192818 - RNA, 1701 nt, Artificial Sequence; identical to SEQ ID NO: 189891
  derived and/or modified sequence opt5 from hemagglutinin__InfluenzaA__AGB13300

SEQ ID NO: 192819 - RNA, 1701 nt, Artificial Sequence
  derived and/or modified sequence opt5 from hemagglutinin__InfluenzaA__AGB13310
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaauccuuuuauaagaaucugaucuggcucguuaaaaagggcaacucuuacccuaaacuguccaagagcuauauuaaugacaaggggaaagaagugcuuguccuguggggagugcaccaccccuccaccucugccgaucaacagagccucuaccagaacgcugacgccuacguguucgucggcacauccagauauagcaagaaauuuaagccugagaucgcuauucggccgaaaguucgcgaucaggaggggagaaugaauuacuauuggacccugguggaacccggagacaagaucacguucgaggccacaggcaaccugguggucccucgguacgcguuugccauggaacgcaacgcugggucuggaauuaucauuuccgauacccccgugcaugacugcaauacaaccugucaaaccccuaaaggcgccaucaacacaagccuccccuuccagaauauccacccgauuacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagcacgccaucgacgagaucaccaacaaggugaauagcguuauugagaaaaugaacacgcaguuuacagcugugggaaaggaguucaaucaucuugagaagagaaucgaaaaccugaauaaaaaggucgaugacggcuuccucgauauuuggaccuacaacgccgagcugcuggugcuccuggaaaaugagcggacccuugacuaucacgauagcaacgucaaaaaucuguacgagaaggugcgcucucagcucaaaaacaacgccaaggaaaucgggaauggauguuuugaguucuaucauaagugcgacaacacauguauggaauccguuaaaaauggcaccuacgauuauccuaaguacagcgaggaagcuaaacugaacagagaggagauugacggggugaaacuugaaucuacacggaucuaucaaauccuggccauuuacuccacggucgcgagcucccucgugcugguugugucucugggcgcuaucagcuuuuggaugugcuccaauggaucucuccagugccgcauuuguaucuga

SEQ ID NO: 192820 - RNA, 1701 nt, Artificial Sequence
  derived and/or modified sequence opt5 from hemagglutinin__InfluenzaA__AGB13320
augaaggccauccuggugguccuccuguacaccauugcuacagccaacgcggacacgcuuugcaucggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacauugccggguggauccugggaaauccugagugugaaucucucagcacagccuccucuuggagcuacauuguggagaccuccucuagcgacaacggcacgugcuauccgggggauuucaucaauuacgaggaacugcgggagcagcuuuccagcgucucuuccuuugaacgcuucgagaucuuucccaagaccagcucuuggccuaaccacgacuccaauaagggagugacagccgcuuguccccaugccggcgcgaaaucuuucuauaagaaccugauuuggcucguuaaaaagggcaauagcuacccuaaacuguccaagagcuauaucaacgauaaggggaaagaagugcuuguccuguggggcauucaccaccccuccaccacagccgaccaacagucucucuaccagaaugcugaugccuacguguuugugggaaccagcagauauuccaagaaauucaagccugagaucgcuauucggccgaaaguccgcgaccaggaggggagaaugaacuacuauuggacgcugguugaacccggagauaagaucacauuugaggccaccggcaaccugguggugccucgguacgcguucgccauggaaaagaaugcugggagcggaauuaucaucucugacacacccguccaugauugcaacaccaccugucaaacaccuaagggcgccauuaauacgucccuccccuuucagaacauccacccgauuaccaucggcaagugcccuaaauauguuaagagcacaaaacugcgccuugcuaccgggcugagaaaugugcccucuauucagagccggggacucuucggcgccaucgccggguuuaucgagggaggcuggacagggaugguggacggaugguacggcuaucaucaccagaacgaacaaggcuccggguacgcugcggaccugaagucuacccagaaugccauugauaaaaucacgaacaaggucaauagcgugauugagaagaugaacacacaguucaccgcuguuggaaaagaguuuaaucaccuugaaaagcgcaucgagaaccugaauaaaaagguggacgauggcuuccucgacauuuggaccuacaacgccgaacugcugguccuccuggagaaugaaagaacacuugauuaucaugacuccaacgugaaaaaccuguacgagaagguccggaaucagcucaagaacaaugccaaagagaucgggaacggauguuucgaauuuuaucacaagugcgauaauaccuguauggagagcgugaaaaacggcacauacgacuauccuaaguacucugaagaggcuaaacugaaucgcgaagagaucgaugggguuaaacuugaguccgccagaguguaucaaauucuggcgaucuacagcacggucgcuucuucccucgugcugguugugagccugggcgccauuuccuucuggaugugcucuaacggaagccuccagugccggaucuguauuuga

SEQ ID NO: 192821 - RNA, 1701 nt, Artificial Sequence
  derived and/or modified sequence opt5 from hemagglutinin__InfluenzaA__AGB13330
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaaaugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuaaguccuauagcaaugacaagggaaaagaagugcugguccuuuggggcauucaccaccccuccaccacagccgaucaacagucucuguaccagaacgcugacaccuacguguucguggggacgagcagauauuccaagaaauuuaagccugagaucgccauucggccgaaaguccgcgaucaggagggaagaaugaauuacuauuggacacucguugaacccggcgacaagaucaccuucgaggcuacagggaaccugguggugccucgguacgccuuugcgauggaacgcaacgccggaagcggcauuaucauuucugauacccccguccaugacugcaauaccacaugucaaacgccuaaaggcgcuaucaacaccucccugcccuuccagaauauccacccgauuacaaucgggaagugcccuaaguaugugaaaagcaccaagcucagacuggccacaggacuucggaacguucccucuauucagagccgcggccuguuuggggcuaucgccggauucauugagggcggguggaccggaaugguggacggcugguacggcuaucaucaccagaaugaacaaggguccggauacgccgcugaucucaaaucuacgcagaacgcgaucgacaagaucacaaauaaagucaacagcgugauugagaagaugaauacccaguuuaccgccguuggcaaggaguucaaccaccuggaaaagagaaucgagaaucuuaacaagaaaguggaugacggguuccuggauauuuggacauacaaugcugaacuccugguccugcucgagaacgaacggacccuggacuaucaugauuccaaugugaagaaccuuuacgagaaaguccgcaaccagcugaagaauaacgccaaggagaucggaaauggcuguuuugaguucuaucacaaaugcgacaacacauguauggagagcgugaagaaugggacguacgauuauccuaaauacucugaagaggccaagcucaacagagaagagauugacggcguuaaacuggaguccacccggaucuaucaaauccuugcuauuuacagcacaguggccucuucccugguccucgugguuagccugggagcgaucuccuuuuggaugugcucuaauggcagccugcagugccgcauuuguaucuga

SEQ ID NO: 192822 - RNA, 1701 nt, Artificial Sequence; identical to SEQ ID NO: 189891
  derived and/or modified sequence opt5 from hemagglutinin__InfluenzaA__AGB13340

SEQ ID NO: 192823 - RNA, 1701 nt, Artificial Sequence
  derived and/or modified sequence opt5 from hemagglutinin__InfluenzaA__AGB13350
augaaggccauccuggugguccuccuguacaccuucgcuacagccaacgcggacacgcuuugcauuggcuaucacgcuaauaacagcaccgagacaguugauaccgugcuggagaaaaaugugacagucacccauuccgugaaccuccuggaagacaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgauaacggcacgugcuauccgggggacuuuauuaauuacgaggagcugcgggaacagcuuuccagcgucucuuccuucgagcgcuuugaaaucuuccccaagaccagcucuuggccuaaccacgauuccaauaagggagugacagccgcuuguccccaagccggcgcgaaaucuuuuuauaagaaccugaucuggcucguuaaaaagggcaauagcuacccuaaacuguccaagagcuauauuaacgacaaggggaaagaggugcuuguccuguggggaauccaucaccccuccaccucugccgaucagcagagccucuaccagaaugcugacgccuacguguucgugggcacauccaaguauagcaaaaaguuuaaaccugagauugcugucagaccgaagguucgggaucaagaagggcgcaugaacuacuauuggacccugguggagcccggagacaaaaucacguucgaagccacaggcaaccugcucgugccuagauacgcguuugccauggagcggaaugcugggucuggaauuaucauuuccgauacccccguccacgacugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcauucagucccggggacuguuuggcgccaucgccggguucauugaaggaggcuggaccgggaugguggauggaugguacggcuaucaccaucaaaacgcucagggcucuggguacgcggccgaccuuaagagcacacagaaugcuaucgacaaaaucaccaacaaggucaauuccgugauugagaagaugaacacgcaguuuacagccguuggaaaagaguucaaucaccuggaaaagcgcaucgagaaccucaauaaaaagguggaugacggcuuccuggauauuuggaccuacaacgccgaacugcucguccugcuugagaaugaaagaacccuggacuaucacgauagcaacgugaaaaaccucuacgagaagguccggucucaacugaagaauaacgcuaaagagaucgggaauggauguuuugaguucuaucauaagugcgacaacacauguauggaauccgugaaaaauggcaccuacgauuauccuaaguacagcgaagaggccaaacuuaaccgcgaagagauugacgggguuaagcuggagucuacaagaaucuaucagauccucgcgauuuacuccacgguggcuagcucccugguccuggugguuucucucggcgccaucagcuuuuggaugugcuccaauggaucucugcagugccggauuuguaucuga

SEQ ID NO: 192824 - RNA, 1701 nt, Artificial Sequence
  derived and/or modified sequence opt5 from hemagglutinin__InfluenzaA__AGB13360
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaucaccagaacgaacaaggcucuggguacgcugcggaccuuaagagcacacagaaugccaucgauaaaaucaccaacaaggucaauuccgugauugagaagaugaacacgcaguuuacagcuguuggaaaagaguucaaucaccuggaaaagcgcaucgagaaccucaauaaaaagguggacgauggcuuccuggacauuuggaccuacaacgccgaaaugcugguccuccuggagaaugaaaagacccuugauuaucaugacagcaacgugaagaaccuguacgagaaggucagaucucagcucaaaaauaacgccaaggagaucgggaauggauguuuugaguucuaucacaaaugcgauaacacauguauggaguccgugaagaauggcaccuacgacuauccuaaauacagcgaagaggcuaagcugaaccgggaagagauugaugggguuaaacuugagucuacacgcaucuaucaaauccuggccauuuacuccacgguggcgagcucccucguccuggugguuucucugggcgcuaucagcuuuuggaugugcuccaauggaucucuccagugcagaauuuguaucuga

SEQ ID NO: 192825 - RNA, 1701 nt, Artificial Sequence
  derived and/or modified sequence opt5 from hemagglutinin__InfluenzaA__AGB13380
augaaggccauccuggugguccuccuguacaccuucgcuacagccaaggcggacacgcuuugcauuggcuaucacgcuaacaauagcaccgauacaguugacaccgugcuggagaagaacgugacagucacccauuccgugaaucuccuggaagauaaacacaacgggaaacuuuguaagcugagaggaguugcgccccuccaucugggcaagugcaauaucgccggguggauucugggaaacccugagugugaaucucucagcacagcuuccucuuggagcuacaucguggagaccuccucuagcgacaauggcacgugcuauccgggggauuuuauuaacuacgaagaacugcgggagcagcuuuccagcgucucuuccuucgaacgcuuugagaucuuccccaagaccagcucuuggccuaaucacgacuccaacaaaggagugacagccgcuuguccccaugccggcgccaagagcuuuuauaaaaaucugaucuggcucguuaagaaaggcaacucuuacccuaagcuguccaagagcuauauuaaugauaaagggaaggaagugcuuguccuguggggaauccaccaccccuccaccacagccgaccaacagucucucuaccagaacgcugaugccuacguguucgugggcaccagcagauauuccaaaaaguuuaaaccugagauugcuauccggccgaagguccgcgaccaggaggggagaaugaauuacuauuggacgcugguugaacccggagauaaaauuacauucgaggccaccggcaaccugguggugccucgguacgcguuugccauggaacgcaaccccgggagcggaaucauuaucucugacacaccuguccaugauugcaauaccaccugucaaacacccaagggcgcuaucaacacgucccucccguuccagaauauucacccuaucaccauuggcaagugccccaaauauguuaagagcacaaaacugagacuugccaccgggcugcggaacgugccuucuauccagagccgcggacucuuuggcgcuauugccggguucaucgagggaggcuggacagggaugguggacggaugguacggcuaucaucaccagaaugaacaaggcuccggguacgccgcugaccugaagucuacccagaacgcgaucgauaaaauuacgaauaaggucaacagcgugaucgagaagaugaauacacaguuuaccgccguuggaaaagaguucaaccaccuugaaaagagaauugagaaucugaacaaaaagguggacgauggcuuccucgacaucuggaccuacaaugcugaacugcugguccuccuggagaacgaacggacacuugauuaucaugacuccaaugugaaaaaccuguacgagaagguccgcaaccagcucaagaauaacgccaaagagauugggaauggauguuuugaguucuaucacaagugcgauaacaccuguauggagagcgugaaaaauggcacauacgacuaucccaaguacucugaagaggccaaacugaacagagaagagaucgaugggguuaaacuugaguccacgcggaucuaucaaauucuggcuaucuacagcaccguggccucuucccucguccuggugguuagccugggcgcgauuuccuuuuggaugugcucuaauggaagccuccagugccgcaucuguauuuga

SEQ ID NO: 192826 - RNA, 1701 nt, Artificial Sequence; identical to SEQ ID NO: 189459
  derived and/or modified sequence opt5 from hemagglutinin__InfluenzaA__AGB13390

SEQ ID NO: 192827 - RNA, 1701 nt, Artificial Sequence; identical to SEQ ID NO: 190066
  derived and/or modified sequence opt5 from hemagglutinin__InfluenzaA__AGB13400

SEQ ID NO: 192828 - RNA, 1701 nt, Artificial Sequence; identical to SEQ ID NO: 189459
  derived and/or modified sequence opt5 from hemagglutinin__InfluenzaA__AGB13410

SEQ ID NO: 192829 - RNA, 1701 nt, Artificial Sequence; identical to SEQ ID NO: 189478
  derived and/or modified sequence opt5 from hemagglutinin__InfluenzaA__AGB13420

SEQ ID NO: 192830 - RNA, 1701 nt, Artificial Sequence
  derived and/or modified sequence opt5 from hemagglutinin__InfluenzaA__AGB13430
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagauguuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauaucaaugacaaggggaaagaagugcuuguccuguggggcauucaccaucccccuacauccgcggaucaacagucucucuaccagaacgccgacgcuuacguguucgugggaaccagcagauauuccaagaaauuuaagccggagaucgccauucggcccaaaguccgcgaucaggaggggagaaugaauuacuauuggacgcugguugaaccuggagacaagaucacauucgaggcuaccggcaaccugguggugccccgguacgccuuugcgauggaacgcaacgccgggagcggaauuaucauuucugauacaccuguccacgacugcaauaccaccugucaaacacccaaaggcgcuaucaacacgucccucccguuccagaauauccacccuauuaccaucggcaagugccccaaguaugugaaaagcacaaagcugagacuugccaccgggcugcggaacguuccuucuauucagagccgcggacucuuuggcgcuaucgccggguucauugagggaggcuggacagggaugguggacggaugguacggcuaucaucaccagaaugaacaaggcuccggguacgccgcugaucugaaaucuacccagaacgcgaucgacggaaucacgaauaaggucaacagcgugauugagaaaaugaauacacaguuuaccgccguuggcaaggaguucaaccaccuugaaaagagaaucgagaaucugaacaaaaagguggaugacggguuccucgauauuuggaccuacaaugcugaacugcugguccuccuggagaacgaacggacacuugacuaucaugauuccaaugugaaaaaccuguacgagaagguccgcagccagcucaaaaacaaugccaaggagaucggaaacggcuguuuugaguucuaucacaagugcgacaauaccuguauggagucugugaaaaacgggacauacgauuaucccaaguacuccgaagaggccaaacugaauagagaagagauugacggcguuaaacuugagagcacgaugaucuaucaaauccuggcuauuuacucuaccguggccuccagccucguccuggugguuucccugggagcgaucucuuuuuggaugugcagcaacggcucccuccagugccggauuuguaucuga

SEQ ID NO: 192831 - RNA, 1701 nt, Artificial Sequence; identical to SEQ ID NO: 190066
  derived and/or modified sequence opt5 from hemagglutinin__InfluenzaA__AGB13440

SEQ ID NO: 192832 - RNA, 1701 nt, Artificial Sequence; identical to SEQ ID NO: 189478
  derived and/or modified sequence opt5 from hemagglutinin__InfluenzaA__AGB13450

SEQ ID NO: 192833 - RNA, 1701 nt, Artificial Sequence; identical to SEQ ID NO: 189459
  derived and/or modified sequence opt5 from hemagglutinin__InfluenzaA__AGB13460

SEQ ID NO: 192834 - RNA, 1701 nt, Artificial Sequence; identical to SEQ ID NO: 189891
  derived and/or modified sequence opt5 from hemagglutinin__InfluenzaA__AGB13470

SEQ ID NO: 192835 - RNA, 1701 nt, Artificial Sequence; identical to SEQ ID NO: 189478
  derived and/or modified sequence opt5 from hemagglutinin__InfluenzaA__AGB13480

SEQ ID NO: 192836 - RNA, 1701 nt, Artificial Sequence; identical to SEQ ID NO: 189891
  derived and/or modified sequence opt5 from hemagglutinin__InfluenzaA__AGB13490

SEQ ID NO: 192837 - RNA, 1701 nt, Artificial Sequence
  derived and/or modified sequence opt5 from hemagglutinin__InfluenzaA__AGB13500
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccugaccacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacgccuacguguucguggggacaagcagauauuccaagaaauuuaagccugagauugcuauccggccgaaaguccgcgaucaggagggaagaaugaauuacuauuggacccugguugaacccggcgacaagauuacguucgaggccacagggaaccugguggcgccucgguacgccuuugcuauggaacgcaacgccggaagcggcaucauuaucucugauacccccgugcaugacugcaauacaaccugucaaaccccuaaaggcgcuaucaacacaucccuccccuuccagaauauucacccgaucacgauugggaagugcccuaaguaugucaaaagcaccaagcugagacuugccacaggacugcggaacgugcccucuauccagagccgcggccucuuuggggccauugcuggauucaucgagggcggguggaccggaaugguugacggcugguacggcuaucaucaccagaaugaacaaggguccggauacgcggccgaucugaaaucuacacagaacgcuaucgacaagauuaccaauaaagugaacagcgucaucgagaagaugaauacgcaguuuacagccgugggcaaggaguucaaccaccuugagaaaagaauugagaaucugaacaagaaaguugaugacggguuccucgauaucuggaccuacaaugccgaacugcuggugcuccuggagaacgaacggacccuugacuaucaugauuccaaugucaagaaccuguacgagaaagugcgcagccagcucaagaacaaugcuaaggagauuggaaacggcuguuuugaguucuaucacaaaugcgacaauacauguauggaaucugucaagaacgggaccuacgauuauccuaaauacuccgaagaggccaagcugaauagagaagagaucgacggcgugaaacuugagagcacacggaucuaucaaauucuggcgaucuacucuacgguugcuuccagccucgugcuggucgugucccugggagccauuucuuuuuggaugugcagcaacggcucccuccagugccgcaucuguauuuga

SEQ ID NO: 192838 - RNA, 1701 nt, Artificial Sequence; identical to SEQ ID NO: 190096
  derived and/or modified sequence opt5 from hemagglutinin__InfluenzaA__AGB13520

SEQ ID NO: 192839 - RNA, 1701 nt, Artificial Sequence
  derived and/or modified sequence opt5 from hemagglutinin__InfluenzaA__AGB13530
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugaauaaguccuauauuaacgacaaggggaaagaagugcuuguccuguggggaauccaccaccccagcaccacagccgaucaacagucccucuaccagaaugcugacgccuacguguucgugggcaccucuagauauagcaagaaauuuaagccugagauugcuauccggccgaaaguccgcgaucaggaggggagaaugaacuacuauuggacgcugguugaacccggagacaagauuacauucgaggccaccggcaaccugguggugccucgguacgcguuugccauggaacgcaaugcuggguccggaaucauuaucagcgauacacccguccaugacugcaacaccaccugucaaacaccuaaaggcgccaucaauacgucucuccccuuccagaacauucacccgaucaccauuggcaagugcccuaaguaugugaaauccacaaagcugagacuugcuaccgggcugcggaauguucccagcauccagucucgcggacucuuuggcgccauugccggguucaucgagggaggcuggacagggaugguggacggaugguacggcuaucaucaccagaacgaacaaggcagcggguacgcugcggaucugaaauccacccagaaugccaucgacaagauuacgaacaaagucaauucugugaucgagaagaugaacacacaguuuaccgcuguuggaaaggaguucaaucaccuugagaaaagaauugagaaccugaauaagaaaguggaugacggcuuccucgauaucuggaccuacaacgccgaacugcugguccuccuggagaaugaacggacacuugacuaucaugauagcaacgugaagaaccuguacgagaaaguccgcaaucagcucaagaacaaugccaaggagauugggaacggauguuuugaguucuaucacaaaugcgacaauaccuguauggaauccgugaagaacggcacauacgauuauccuaaauacagcgaagaggcuaagcugaauagagaagagaucaacgggguuaaacuugagucuacgcggaucuaucaaauucuggccaucuacuccaccguggcgagcucucucguccuggugguuucccugggcgcuauuagcuuuuggaugugcuccaauggaucucuccagugccgcaucuguauuuga

SEQ ID NO: 192840 - RNA, 1701 nt, Artificial Sequence; identical to SEQ ID NO: 190110
  derived and/or modified sequence opt5 from hemagglutinin__InfluenzaA__AGB13540

SEQ ID NO: 192841 - RNA, 1701 nt, Artificial Sequence; identical to SEQ ID NO: 190074
  derived and/or modified sequence opt5 from hemagglutinin__InfluenzaA__AGB13550

SEQ ID NO: 192842 - RNA, 1701 nt, Artificial Sequence; identical to SEQ ID NO: 190074
  derived and/or modified sequence opt5 from hemagglutinin__InfluenzaA__AGB13560

SEQ ID NO: 192843 - RNA, 1701 nt, Artificial Sequence; identical to SEQ ID NO: 189891
  derived and/or modified sequence opt5 from hemagglutinin__InfluenzaA__AGB13570

SEQ ID NO: 192844 - RNA, 1701 nt, Artificial Sequence
  derived and/or modified sequence opt5 from hemagglutinin__InfluenzaA__AGB13580
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugguugaacccggagauaagauuacauucgaggccaccggcaaccugguggugccucgguacgcguuugccauggaacgcaaugcugggagcggaaucauuaucucugacacacccguccaugauugcaacaccaccugucaaacaccuaaaggcgccaucaauacgucccuccccuuccagaacauucacccgaucaccauuggcaagugcccuaaguaugugaaaagcacaaagcugagacuugcuaccgggcugcggaauguucccucuauccagagccgcggacucuuuggcgccauugccggguucaucgagggaggcuggacagggaugguggacggaugguacggcuaucaucaccagaacgaacaaggcuccggguacgcugcggaccugaaaucuacccagaaugccaucgauaagauuacgaacaaagucaauagcgugaucgagaagaugaacacacaguuuaccgcuguuggaaaggaguucaaucaccuugagaaaagaauugagaaccugaauaagaaaguggacgauggcuuccucgacaucuggaccuacaacgccgaacugcugguccuccuggagaaugaacggacacuugauuaucaugacuccaacgugaagaaccuguacgagaaaguccgcaaucagcucaagaacaaugccaaggagauugggaacggauguuuugaguucuaucacaaaugcaauaacaccuguauggaaagcgugaagaauggcacauacgauuauccuaaauacucugaagaggcuaagcugaacagagaagagaucgacgggguuaaacuugaguccacgcggaucuaucaaauucuggccaucuacagcaccguggcgucuucccucguccuggugguuagccugggcgcuauuuccuuuuggaugugcucuaauggaagccuccagugccgcaucuguauuuga

SEQ ID NO: 192845 - RNA, 1701 nt, Artificial Sequence
  derived and/or modified sequence opt5 from hemagglutinin__InfluenzaA__AGB13590
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuugccauggaacgcaaugcugggagcggaaucauuaucucugacacacccguccaugauugcaacaccaccugucagacaccuaagggcgccaucaauacgucccuccccuuccagaacauucacccgaucaccauuggcaaaugcccuaaguauguuaagagcacaaaacugagacuugcuaccgggcugcggaaugugcccucuauccagagccgcggacucuuuggcgccauugccggguucaucgagggaggcuggacagggaugguggacggaugguacggcuaucaucaccaaaacgaacagggcuccggguacgcugcggaccugaagucuacccagaaugccaucgauaaaauuacgaacaaggucaauagcgugaucgagaaaaugaacacacaguuuaccgcuguuggaaaggaguucaaucaccuugaaaagagaauugagaaccugaauaaaaagguggacgauggcuuccucgacaucuggaccuacaacgccgaacugcugguccuccuggagaaugaacggacacuugauuaucaugacuccaacgugaaaaaccuguacgagaagguccgcaaucaacucaaaaacaaugccaaggagauugggaacggauguuuugaguucuaucacaagugcgauaauaccuguauggagagcgugaaaaacggcacauacgacuauccuaaguacucugaagaggcuaaacugaauagagaagagaucgaugggguuaaacuugaguccacgcggaucuaucagauucuggccaucuacagcaccguggcgucuucccucguccuggugguuagccugggcgcuauuuccuuuuggaugugcucuaacggaagccuccagugccgcaucuguauuuga

SEQ ID NO: 192846 - RNA, 1701 nt, Artificial Sequence
  derived and/or modified sequence opt5 from hemagglutinin__InfluenzaA__AGB13600
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugaacaaguccuauauuaaugauaaggggaaagaagugcuuguccuguggggaauccaccaccccagcaccacagccgaccaacagucccucuaccagaacgcugaugccuacguguucgugggcaccucuagauauagcaagaaauuuaagccugagauugcuauccggccgaaaguccgcgaccaggaggggagaaugaacuacuauuggacgcugguugaacccggagauaagauuacauucgaggccaccggcaaucugguggugccucgguacgcguuugccauggaacgcaacgcuggguccggaaucauuaucagcgacacacccguccaugauugcaauaccaccugucaaacaccuaaaggcgccaucaacacgucucuccccuuccagaauauucacccgaucaccauuggcaagugcccuaaguaugugaaauccacaaagcugagacuugcuaccgggcugcggaacguucccagcauccagucucgcggacucuuuggcgccauugccggguucaucgagggaggcuggacagggaugguggacggaugguacggcuaucaucaccagaaugaacaaggcagcggguacgcugcggaccugaaauccacccagaacgccaucgauaagauuacgaauaaagucaacucugugaucgagaagaugaauacacaguuuaccgcuguuggaaaggaguucaaccaccuugagaaaagaauugagaaucugaacaagaaaguggacgauggcuuccucgacaucuggaccuacaaugccgaacugcugguccuccuggagaacgaacggacacuugauuaucaugacagcaacgugaagaaucuguacgagaaaguccgcaaccagcucaagaauaacgccaaggagauugggaauggauguuuugaguucuaucacaaaugcgauaacaccuguauggaauccgugaagaauggcacauacgacuauccuaaauacagcgaagaggcuaagcugaacagagaagagaucgaugggguuaaacuugagucuacgcggaucuaucaaauucuggccaucuacuccaccguggcgagcucucucguccuggugguuucccugggcgcuauuagcuuuuggaugugcuccaauggaucucuccagugccgcaucuguauuuga

SEQ ID NO: 192847 - RNA, 1701 nt, Artificial Sequence; identical to SEQ ID NO: 189891
  derived and/or modified sequence opt5 from hemagglutinin__InfluenzaA__AGB13610

SEQ ID NO: 192848 - RNA, 1701 nt, Artificial Sequence; identical to SEQ ID NO: 190110
  derived and/or modified sequence opt5 from hemagglutinin__InfluenzaA__AGB13620

SEQ ID NO: 192849 - RNA, 1701 nt, Artificial Sequence; identical to SEQ ID NO: 189478
  derived and/or modified sequence opt5 from hemagglutinin__InfluenzaA__AGB13630

SEQ ID NO: 192850 - RNA, 1701 nt, Artificial Sequence
  derived and/or modified sequence opt5 from hemagglutinin__InfluenzaA__AGB13640
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacggaauuacgaauaaggucaacagcgugaucgagaaaaugaauacacaguuuaccgccguuggcaaggaguucaaccaccuugaaaagagaauugagaaucugaacaaaaagguggaugacggguuccucgauaucuggaccuacaaugcugaacugcugguccuccuggagaacgaacggacacuugacuaucaugauuccaaugugaaaaaccuguacgagaagguccgcagccagcucaaaaacaaugccaaggagauuggaaacggcuguuuugaguucuaucacaagugcgacaauaccuguauggagucugugaaaaacgggacauacgauuaucccaaguacuccgaagaggccaaacugaauagagaagagaucgacggcguuaaacuugagagcacgaugaucuaucaaauucuggcuaucuacucuaccguggccuccagccucguccugauugugucccugggagcgaucucuuuuuggaugugcagcaacggcucccuccagugccggauuuguaucuga

SEQ ID NO: 192851 - RNA, 1701 nt, Artificial Sequence
  derived and/or modified sequence opt5 from hemagglutinin__InfluenzaA__AGB13650
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgaucaggaggggagaaugaauuacuauuggacgcugguugaaccuggagacaagauuacauucgaggcuaccggcaaccugguggugccccgguacgccuuugcgauggaacgcaacgccgggagcggaaucauuaucucugauacaccuguccacgacugcaauaccaccugucaaacacccaaaggcgcuaucaacacgucccucccguuccagaauauucacccuaucaccauuggcaagugccccaaguaugugaaaagcacaaagcugagacuugccaccgggcugcggaacguuccuucuauccagagccgcggacucuuuggcgcuauugccggguucaucgagggaggcuggacagggaugguggacggaugguacggcuaucaucaccagaaugaacaaggcuccggguacgccgcugaucugaaaucuacccagaacgcgaucgacggaauuacgaauaaggucaacagcgugaucgagaaaaugaauacacaguuuaccgccguuggcaaggaguucaaccaccuugaaaagagaauugagaaucugaacaaaaagguggaugacggguuccucgauaucuggaccuacaaugcugaacugcugauucuccuggagaacgaacggacacuugacuaucaugauuccaaugucaaaaaccuguacgagaaggugcgcagccagcucaaaaacaaugccaaggagaucggaaacggcuguuuugaguucuaucacaagugcgacaauaccuguauggagucugucaaaaacgggacauacgauuaucccaaguacuccgaagaggccaaacugaauagagaagagaucgacggcgugaaacuugagagcacgaugauuuaucaaauccuggcuauuuacucuaccguugccuccagccucgugcugaucgucucccugggagcgauuucuuuuuggaugugcagcaacggcucccuccagugccggaucuguauuuga

SEQ ID NO: 192852 - RNA, 1701 nt, Artificial Sequence; identical to SEQ ID NO: 189848
  derived and/or modified sequence opt5 from hemagglutinin__InfluenzaA__AGB13660

SEQ ID NO: 192853 - RNA, 1701 nt, Artificial Sequence; identical to SEQ ID NO: 189459
  derived and/or modified sequence opt5 from hemagglutinin__InfluenzaA__AGB13721

SEQ ID NO: 192854 - RNA, 1701 nt, Artificial Sequence; identical to SEQ ID NO: 189891
  derived and/or modified sequence opt5 from hemagglutinin__InfluenzaA__AGB13731

SEQ ID NO: 192855 - RNA, 1701 nt, Artificial Sequence
  derived and/or modified sequence opt5 from hemagglutinin__InfluenzaA__AGB51356
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauagacacaaugggaagcugugcaaacucggaggcaucgcuccccugcaucuggggaaguguaacauugccggauggcuccugggcaauccugagugcgaacuucugcucacagugucuagcugguccuauaucguugagaccucuaacagcgacaaugggacguguuacccgggagauuuuauuaacuaugaagaacugcgggagcagcuuuccucugugagcuccuucgaacgcuuugagaucuuccccaaaaccagcucuuggccuaaucacgaaacaaacagaggcgucaccgccgccugccccuacgcuggcgccaauuccuuuuaucggaaccugaucuggcucguggagaaggggaauagcuacccuaagcugucuaaauccuauguuaacaacaagggaaaagaggugcugguccucuggggcauucaucaucccccuacaagcaccgaccaacagucucuguaccagaaugcggaugccuacguguucgugggguccagcaaguauaaccgcaaauuuaagccggaaaucgcugccagacccaagguccggggacaggcuggccgcaugaauuacuauuggacgcuuauugagccuggggacacaaucaccuucgaagccacaggaaaccugguugugcccagauacgcguuugccaugaaucggggcuccggcucugggauuaucauuagcgaugcuccugugcacgacuguaacaccaaaugccaaacccccaagggagccaucaauacaucccucccguuccagaacauccacccugucacgauuggcgagugucccaaauauguuaagagcaccaaacugcgcauggcuacagggcuuagaaauaucccuucuauucagucccggggacuguuuggcgccaucgccggguucauugaaggaggcuggaccggcaugaucgaugggugguacggauaucaccaucagaacgagcaaggcagcggguacgcugcggaccagcgcucuacacagaaugccaucgauggaauuaccaacaaggugaauagcgugaucgagaaaaugaacacgcaguuuacagcugucggcaaggaguucaaucaccucgagaagagaauugaaaaccugaacaaaaagguggacgacggguuccuggauaucuggaccuacaaugccgagcuccugguucuucuggaaaacgagcggacccucgacuuucacgauuccaaugugaaaaaccuguaugagaagguccgcucucaacuuagaaauaacgccaaagaaauuggcaauggaugcuucgaguuuuaccauaagugugacgauacaugcauggaaagcgugaagaacggcaccuaugacuaccccaaauauuccgaggaaagcaagcugaaucgggaggagaucgauggggucaaacucgaaucuacaagaaucuaccagauucuggcuaucuauuccacgguggccagcucucugguucuccuggugucccuuggagcgauuagcuucuggaugugcuccaacggcucucugcagugucgcaucugcauuuga

SEQ ID NO: 192856 - RNA, 1701 nt, Artificial Sequence
  derived and/or modified sequence opt5 from hemagglutinin__InfluenzaA__AGB97269
augaaggccauccuggugguccuccuguacaccuucgcuacagccaacgcggacacgcuuugcauuggcuaucacgcuaauaacagcaccgauacaguugacaccgugcuggagaaaaauaucacagugacccauuccgucaaccuccuggaagauaagcacaaugggaaacuuuguaagcugagaggaguggcuccccuccaucugggcaaaugcaacauugccggguggauccugggaaauccugagugugaaacacucucuaccgccagcuccuggucuuacauuguugagacgagcuccucugacaacgggaccugcuauccgggcgauuuuaucgacuacgaagaacugcgggagcagcuuagcuccgugagcucuuucgaacgcuuugagaucuuccccaagacauccagcuggccuaaucacgauucuaacaagggagucaccgccgcuuguccccaugccggcgcgaaaggcuuuuauaagaaucugauuuggcucgugaaaaaggggaacuccuacccuaaacugagcaagucuuauaucaaugacaagggaaaagaaguucuugugcuguggggcauucaccaccccuccacaaccgccgaucaacagagccucuaccagaacgcugacacguacgucuucguggggacauccagauauucuaagaaauuuaagccugagaucgccauucggccgaaagugcgcgaucaggagggaagaaugaauuacuauuggacccuggucgaacccggcgacaagaucacauucgaggcuaccgggaaccugguugugccucgguacgccuuugcgauggaacgcgaugccggaagcggcauuaucaucuccgacacccccgugcaugacugcaacacaacgugucaaaccccuaaaggcgcuauuaauacaagccuccccuuccagaacauccacccgauuaccaucgggaagugcccuaaguaugucaaaucuacaaagcugagacuugccaccggacugcggaaugugcccuccauucagagccgcggccucuuuggggcuaucgccggauucaucgagggcggguggacgggaaugguugauggcugguacggcuaucaucaccagaacgaacaagggucuggauacgccgcugaccugaaaagcacacagaaugcgauugauaagaucaccaacaaagucaauuccgugauugagaagaugaacacccaguuuacagccgugggcaaggaguucaaucaccuugagaaaagaaucgagaaccugaauaagaaaguugacgauggguuccucgacauuuggaccuacaacgcugaacugcuggugcuccuggagaaugaacggacacuugauuaucaugacucuaacgucaagaaucuguacgagaaagugcgcaaccagcucaagaacaaugccaaggagaucggaaacggcuguuuugaguucuaucacaaaugcgauaauacguguauggaaagcgucaagaacgggaccuacgacuauccuaaauacuccgaagaggccaagcugaauagagaagagaucgauggcgugaaacuugagagcacacggauuuaucaaauccuggcuauuuacucuaccgccgcguccagccucguucugguggucucucugggagcuaucuccuuuuggaugugcagcaacggcucccuccagugccgcauuuguaucuga

SEQ ID NO: 192857 - RNA, 1701 nt, Artificial Sequence; identical to SEQ ID NO: 191210
  derived and/or modified sequence opt5 from hemagglutinin__InfluenzaA__AGB97273

SEQ ID NO: 192858 - RNA, 1701 nt, Artificial Sequence
  derived and/or modified sequence opt5 from hemagglutinin__InfluenzaA__AGB97288
augaagaccaucauugcccugggcuacauccucugccugguguucgcucagaaacuucccgggaacgacaauagcacagccacgcugugucucggacaccaugcggucccuaacggcaccauuguuaagacaaucaccaaugauagaauugaggugacaaacgcuaccgaacuggugcaaaauuccucuaucggggagaucugcgacagcccgcaccagauucuugaugggaaaaacuguacacugaucgacgcccuccugggcgauccccagugcgacggguuucagaauaagaaaugggaucuguucauugaacgguccaaggccuauucuaacuguuacccuuaugacguccccgauuacgcuagccuccgcucccugguggccucuagcggaacccuugaguuuaauaacgaauccuucaauuggacgggcguuacccaaaacggcacaagcucugcuugcaucagacgguccaauagcuccuuuuucucucgccugaacuggcucacccaucugaauuuuaaguauccugcccuuaacgugacaaugcccaacaaugagcaguucgacaaacuguacauuuggggaguccaccauccuggaaccgauaaggaccagaucuuucucuaugcgaaaagcucuggcagaauuacgguguccacaaagcggagccagcaagccguuaucccgaacaucgggucccgcccccggauuagaaauaucccuucucgcauuagcaucuacuggaccauugugaaacccggagauauccugcugaucaacuccacaggcaaucucauugcuccuagaggguacuucaagauccggagcggaaagucuuccauuaugcgcagcgacgcccccaucggcaaauguaagucugagugcauuaccccgaacggcagcaucccuaaugacaaacccuuucagaacgucaauagaaucaccuauggggcuuguccucgguacgugaagcaguccacacugaaacuugccacgggaaugcgcaacgugcccgaaaagcagaccagaggcauuuucggggcgaucgccggauuuauugagaauggcugggaagggauggucgauggaugguauggcuuccggcaccaaaacucugagggcagagggcaggcugccgaccugaaaagcacacaggcugccaucgaucaaauuaauggaaagcucaaccgccugaucggcaagaccaaugagaaauuccaccagauugaaaaggaguuuuccgaaguugaggggcggauccaggaccuugaaaaauacguggaggauacaaagaucgaccuguggagcuauaacgccgagcuccugguggcucuggaaaaccagcauaccauugaucucacggacucugagaugaauaaacuguucgaaaagacaaagaaacaacuuagagagaacgcggaagauaugggaaauggcugcuuuaagaucuaccacaaaugugacaacgccugcauuggguccauccgcaauggcaccuaugaucauaacgucuaccgggacgaggcucugaauaacagauuccagauuaagggaguggagcucaaaagcggcuacaaggacuggauccuguggaucucuuuugccauuuccugcuuccuucuguguguugcccuccugggguuuaucaugugggcuugccagaagggaaauauucgcuguaacaucugcauuuga

SEQ ID NO: 192859 - RNA, 1701 nt, Artificial Sequence
  derived and/or modified sequence opt5 from hemagglutinin__InfluenzaA__AGB97292
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuacauacggcgcguguccuagauauguuaagcaaaauacgcugaaacuugccaccgggaugcggaacgugcccgagaagcagacacgcggaaucuucggcgcuauugccggguuuaucgaaaauggaugggagggcaugguggaugggugguacggauucagacaccagaacuccgagggccggggccaagcugccgaccugaaaucuacccaggccgcuaucgaucagauuaaugggaagcucaacagacugaucggaaaaacaaacgaaaaguuccaucagauugagaaagaauuuagcgaggucgaaggccgcauccaagaccuugagaaguauguggaggauaccaagauugaccugugguccuacaaugcggaacuccugguugcccuggagaaccagcacacgaucgaucucacagacagcgaaaugaauaaacuguucgagaagaccaaaaagcagcuucgggaaaacgcugaggauauggggaauggaugcuuuaaaauuuaucauaagugugacaacgccugcaucggcucuaucagaaaugggaccuacgaucacgacguguaucgcgacgaggcccugaacaaucgguuccagauuaagggcgucgaacucaaauccggauacaaggauuggauccuguggauuagcuuugcuaucucuugcuuccuucuguguguggcccuccugggcuuuauuaugugggcgugccaaaaagggaacaucagauguaauaucugcauuuga

SEQ ID NO: 192860 - RNA, 1701 nt, Artificial Sequence
  derived and/or modified sequence opt5 from hemagglutinin__InfluenzaA__AGB97300
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagacaagaaaacagcuucgcgaaaacgcggaggauauggggaauggaugcuuuaagauuuaccacaagugugacaacgccugcaucggcagcauucggaaugggaccuaugaucaugacguguacagagacgaggcucugaacaaucgcuuccagaucaaaggcguugaacucaagucuggauacaaagauuggauucuguggaucuccuuugccaucagcugcuuccuucuguguguggcccuccugggcuuuauuaugugggcuugccagaaggggaacauccgguguaauauuugcaucuga

SEQ ID NO: 192861 - RNA, 1701 nt, Artificial Sequence
  derived and/or modified sequence opt5 from hemagglutinin__InfluenzaA__AGE89267
augaaggccauccugauugugcuccuguacaccuucgcuacagccaacgcggacacgcuuugcaucggcuaucacgcuaauaacagcaccgauacagucgacaccguucuggagaaaaaugugacagugacccauuccgucgaucuccuggaagacaagcacaacgggaaacuuuguaagcugagaggaguggcuccccuccaucugggcaaaugcaauauugccggguggauccugggaaacccugagugugaaucucucagcacagccuccucuuggagcuacauuguugagaccuccucuagcgauaauggcacgugcuauccgggggacuuuaucgauuacgaagaacugcgggagcagcuuuccagcgugucuuccuucgaacgcuuugagaucuuccccaagaccagcucuuggccuaaccacgacuccaauaagggagucacagccgcuuguccccaugccggcgaaaagagcuuuuauaagaaccugauuuggcucgugaaaaagggcaauucuuacccuaaacugaacaaguccuauaucaaugauaaggggaaagagguucuugugcuguggggcauucaccaccccagcaccuccacagaccaacagucucucuaccagaacgcggaugccuacgucuucgugggaaccagcagauauuccaagaaauuuaagccugagaucgcuauucggccgaaagugcgcgaccaggaagggagaaugaauuacuauuggacgcuggucgagcccggagauaagaucacauucgaagccaccggcaaccugguugugccucgguacgcuuuugccauggagcgcaacgcggggagcggaauuaucaucucugacacacccauucaugacugcaauaccaccugucaaacaccuaaaggcgccaucaacacgucccuccccuuccagaauauucacccgaucaccauuggcaagugcccuaaguaugugaaaagcacaaagcugagacuugcuaccgggcugcggaacguccccucuauccagagccgcggacucuuuggcgccaucgcuggguucauugaaggaggcuggacagggaugguggauggaugguacggcuaucaucaccagaaugagcaaggcuccggguacgccgccgaccugaaaucuacccagaacgcuaucgaugagauuacgaauaagguuaacagcgugaucgagaaaaugaauacacaguuuaccgcggucggaaaggaguucaaccaccuugaaaagagaauugagaaucugaacaaaaagguggacgauggcuuccucgacaucuggaccuacaaugccgaacugcugguucuccuggagaacgagcggacacuugauuaucaugacuccaaugugaaaaaccuguacgaaaaggucaaaagccagcucaagaacaaugcuaaggagaucgggaacggauguuuugaguucuaucacaaaugcgauaauaccuguauggaaucugugaagaacggcacauacgacuauccuaaauacuccgaagaggccaagcugaaucgcgagaaaauugauggggucaaacuugaaagcacgagaaucuaucaaauucuggccaucuacucuaccguggcuuccagccucguucugguggucucccugggcgccauuucuuuuuggaugugcagcaacggaucccuccagugccggaucuguauuuga

SEQ ID NO: 192862 - RNA, 1701 nt, Artificial Sequence
  derived and/or modified sequence opt5 from hemagglutinin__InfluenzaA__AGE89277
augaaggccauccugauugugcuccuguacaccuucgcuacagccaacgcggacacgcuuugcaucggcuaucacgcuaauaacagcaccgauacagucgacaccguucuggagaaaaaugugacagugacccauuccgucgaucuccuggaagacaagcacaacgggaaacuuuguaagcugagaggaguggcuccccuccaucugggcaaaugcaauauugccggguggauccugggaaacccugagugugaaucucucagcacagccuccucuuggagcuacauuguugagaccuccucuagcgauaauggcacgugcuauccgggggacuuuaucgauuacgaagaacugcgggagcagcuuaacuccgugagcucuuucgaacgcuuugagaucuuccccaagaccuccagcuggccuaaucacgacucuaacaagggagucacagccgcuuguccccaugccggcgaaaaauccuuuuauaagaaucugauuuggcucgugaaaaagggcaacagcuacccuaaacugaauaagucuuauaucaacgauaaggggaaagagguucuugugcuguggggcauucaccaccccuccaccagcacagaccaacagucccucuaccagaaugcggaugccuacgucuucgugggaaccucuagauauagcaagaaauuuaagccugagaucgcuauucggccgaaagugcgcgaccaggaagggagaaugaacuacuauuggacgcuggucgagcccggagauaagaucacauucgaagccaccggcaaccugguugugccucgguacgcuuuugccauggagcgcaaugcgggguccggaauuaucaucagcgacacacccauucaugacugcaacaccaccugucaaacaccuaaaggcgccaucaauacgucucuccccuuccagaacauucacccgaucaccauuggcaagugcccuaaguaugugaaauccacaaagcugagacuugcuaccgggcugcggaauguccccagcauccagucucgcggacucuuuggcgccaucgcuggguucauugaaggaggcuggacagggaugguggauggaugguacggcuaucaucaccagaacgagcaaggcagcggguacgccgccgaccugaaauccacccagaaugcuaucgaugagauuacgaacaagguuaauucugugaucgaaaagaugaacacacaguuuaccgcggucggaaaggaguucaaucaccuugaaaagagaauugagaaccugaauaaaaagguggacgauggcuuccucgacaucuggaccuacaacgccgaacugcugguucuccuggagaaugagcggacacuugauuaucaugacagcaacgugaaaaaccuguacgaaaaggucaaaucccagcucaagaauaacgcuaaggagaucgggaauggauguuuugaguucuaucacaaaugcgauaacaccuguauggagagcgugaagaauggcacauacgacuauccuaaauacucugaagaggccaagcugaaccgcgagaaaauugauggggucaaacuugaauccacgagaaucuaucaaauucuggccaucuacagcaccguggcuucuucccucguucugguggucagccugggcgccauuuccuuuuggaugugcucuaauggaagccuccagugccggaucuguauuuga

SEQ ID NO: 192863 - RNA, 1701 nt, Artificial Sequence; identical to SEQ ID NO: 191380
  derived and/or modified sequence opt5 from hemagglutinin__InfluenzaA__AGE89287

SEQ ID NO: 192864 - RNA, 1701 nt, Artificial Sequence
  derived and/or modified sequence opt5 from hemagglutinin__InfluenzaA__AGE89298
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacacauguauggaauccgugaagaaugggacguacgauuauccuaaauacagcgaagaggccaagcugaacagagaagagaucgacggcguuaaacuugagucuacccggaucuaucaaauucuggcuaucuacuccacaguggccagcucucucauucuggucgugucccugggagcgaucagcuuuuggaugugcuccaauggcucucuccagugccgcauuuguaucuga

SEQ ID NO: 192865 - RNA, 1701 nt, Artificial Sequence; identical to SEQ ID NO: 189933
  derived and/or modified sequence opt5 from hemagglutinin__InfluenzaA__AGE89308

SEQ ID NO: 192866 - RNA, 1701 nt, Artificial Sequence; identical to SEQ ID NO: 191375
  derived and/or modified sequence opt5 from hemagglutinin__InfluenzaA__AGE89318

SEQ ID NO: 192867 - RNA, 1701 nt, Artificial Sequence
  derived and/or modified sequence opt5 from hemagglutinin__InfluenzaA__AGE89329
augaagaccaucauugcccugagcuacauccucugccugguguucgcucagaaacuucccggcaacgacgauuccacagccacgcugugucucgggcaccaugcggucccuaauggaaccauuguuaagacaaucaccaacgaccaaauugaggugacaaaugcuaccgaacuggugcagucuagcuccacaggcgagaucugcaacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgacaagcuguauauuuggggcgugcaucacccugggacggauaaagaccagaucuuucucuacgcgcaagccucuggacgcauuacaguuuccaccaagagaagccagcaggcugugaucccgaacauuggcucccggccccgcgucagaaauaucccuucucgggugagcaucuauuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugccugcauuaccccgaauggcagcaucccuaacgacaagcccuuucagaaugucaaccgcauuacauacggcgcguguccuagauauguuaaacaaaauacgcugaaacuugccaccgggaugcggaacgugcccgaaaaacagacacgcggaaucuucggcgcuauugccggguuuaucgagaauggaugggaaggcaugguggaugggugguacggauucagacaccagaacuccgagggccggggccaagcugccgaccugaagucuacccaggccgcuaucgaucagauuaaugggaaacucaacagacugaucggaaagacaaacgagaaauuccaucagauugaaaaggaguuuagcgaagucgagggccgcauccaagaccuugaaaaguauguggaggauaccaaaauugaccugugguccuacaaugcggagcuccugguugcccuggaaaaccagcacacgaucgaucucacagacagcgagaugaauaagcuguucgaaaagaccaagaaacagcuucgggagaacgcugaagauauggggaauggaugcuuuaagauuuaucauaagugugacaacgccugcaucggcucuaucagaaaugggaccuacgaucacgacguguaucgcgacgaggcccugaacaaucgguuccagauuaaaggcgucgagcucaaguccggauacaaagauuggauccuguggauuagcuuugcuaucucuugcuuccuucuguguguggcccuccugggcuuuauuaugugggcgugccaaaaggggaacaucagauguaauaucugcauuuga

SEQ ID NO: 192868 - RNA, 1701 nt, Artificial Sequence; identical to SEQ ID NO: 189478
  derived and/or modified sequence opt5 from hemagglutinin__InfluenzaA__AGE89340

SEQ ID NO: 192869 - RNA, 1701 nt, Artificial Sequence; identical to SEQ ID NO: 191378
  derived and/or modified sequence opt5 from hemagglutinin__InfluenzaA__AGE89350

SEQ ID NO: 192870 - RNA, 1701 nt, Artificial Sequence
  derived and/or modified sequence opt5 from hemagglutinin__InfluenzaA__AGE89361
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacaaccgaccaacagucucucuaccagaaugccgaugcuuacguguucgugggcacgagcagauauuccaagaaauuuaagccugagauugccauccggccgaaaguccgcgaccaggaggggagaaugaacuacuauuggacacugguugaacccggagauaagauuaccuucgaggcuacaggcaaccugguggugccucgguacgccuuugcgauggaacgcaaugccgggagcggaaucauuaucucugacacccccguccaugauugcaacaccacaugucaaacgccuaaaggcgcuaucaauaccucccuccccuuccagaacauucacccgaucacaauuggcaagugcccuaaguaugugaaaagcaccaagcugagacuugccacagggcugcggaauguucccucuauccagagccgcggacucuuuggcgcuauugccggguucaucgagggaggcuggaccgggaugguggacggaugguacggcuaucaucaccagaacgaacaaggcuccggguacgccgcugaccugaaaucuacgcagaaugcgaucgauaagauuacaaacaaagucaauagcgugaucgagaagaugaacacccaguuuaccgccguuggaaaggaguucaaucaccuugagaaaagaauugagaaccugaauaagaaaguggacgauggcuuccucgacaucuggacauacaacgcugaacugcugguccuccuggagaaugaacggacccuugauuaucaugacuccaacgugaagaaccuguacgagaaaguccgcaaucagcucaagaacaaugccaaggagauugggaacggauguuuugaguucuaucacaaaugcgauaauacauguauggaaagcgugaagaacggcacguacgacuauccuaaauacucugaagaggccaagcugaauagagaagagaucgaugggguuaaacuugaguccacccggaucuaucaaauucuggcuaucuacagcacaguggccucuucccucguccuggugguuagccugggcgcgauuuccuuuuggaugugcucuaacggaagccuccagugccgcaucuguauuuga

SEQ ID NO: 192871 - RNA, 1701 nt, Artificial Sequence; identical to SEQ ID NO: 191375
  derived and/or modified sequence opt5 from hemagglutinin__InfluenzaA__AGE89371

SEQ ID NO: 192872 - RNA, 1701 nt, Artificial Sequence
  derived and/or modified sequence opt5 from hemagglutinin__InfluenzaA__AGE89382
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccuggugaaacccggagauaagaucacguucgaagccacaggcaaccugcucgugccuagauacgcguuugccauggagcggaaugcugggucuggaauuaucauuuccgacacccccguccaugauugcaacacaaccugucaaaccccuaagggcgccaucaauacaagccugcccuuccagaacauccacccgauuacgaucggcaaaugcccuaaguaugugaaaucuaccaaacuucgccuggcuacagggcucagaaauguucccagcauucagucccggggacuguuuggcgccaucgccggguucauugaaggaggcuggaccgggaugguggacggaugguacggcuaucaucaccagaacgagcaaggcucuggguacgcugcggaccuuaaaagcacacagaaugccaucgauaagaucaccaacaaggucaauuccgugauugaaaagaugaacacgcaguuuacagcuguuggaaaggaguucaaucaccuggagaaacgcaucgaaaaccucaauaagaaaguggacgauggcuuccuggacauuuggaccuacaacgccgagcugcucguccugcuugaaaaugagagaacccuggauuaucaugacagcaacgugaagaaccucuacgaaaagguccggucucagcugaaaaauaacgccaaggagaucgggaauggauguuuugaguucuaucacaaaugcgauaacacauguauggaauccgugaagaauggcaccuacgacuauccuaaauacagcgaggaagcuaaacuuaaccgcgaggaaauugaugggguuaagcuggagucuacaagaaucuaucaaauccucgccauuuacuccacgguggcgagcucccugguccuggugguuucucucggcgcuaucagcuuuuggaugugcuccaauggaucucugcagugccggauuuguaucuga

SEQ ID NO: 192873 - RNA, 1701 nt, Artificial Sequence
  derived and/or modified sequence opt5 from hemagglutinin__InfluenzaA__AGE89392
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguuauccuuacgaugugcccgacuaugcuucucuccggagccugguugccuccagcgggacgcuugaguuuaauaacgagucuuucaauuggaccggagugacacagaacggcaccuccagcgcuugcauccgcagaucuaauaacuccuuuuucagccggcugaauuggcucacacaccugaacuuuaaauacccugcccuuaacgucaccaugcccaauaacgaacaguucgauaagcuguauauuuggggcgugcaucacccugggacggacaaggaucagaucuuucucuacgcgcaagccucuggacgcauuacaguuuccaccaaaagaagccagcaggcugugaucccgaauauuggcucccggccccgcgucagaaacaucccuucucgggugagcaucuauuggacaauugugaagcccggggacauccugcugauuaauuccaccggaaaccucaucgccccucgcggcuacuucaaaauuagaagcgggaagucuuccaucaugcggagcgaugcucccaucggaaaauguaauucugccugcauuaccccgaacggcagcaucccuaaugacaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggacgggugguacggauucagacaccaaaauuccgagggccggggccaggcugccgaucugaaaucuacccaggccgcuaucgaccagauuaacgggaagcucaacagacugaucggaaaaacaaaugaaaaguuccaucagauugagaaagaauuuagcgaggucgaaggccgcauccaagaucuugagaaguauguggaggacaccaagauugaucugugguccuacaacgcggaacuccugguugcccuggagaaucagcacacgaucgaccucacagauagcgaaaugaacaaacuguucgagaagaccaaaaagcagcuucgggaaaaugcugaggacauggggaacggaugcuuuaaaauuuaucauaagugugauaaugccugcaucggcucuaucagaaacgggaccuacgaccacgauguguaucgcgacgaggcccugaauaaccgguuccagauuaagggcgucgaacucaaauccggauacaaggacuggauccuguggauuagcuuugcuaucucuugcuuccuucuguguguggcccuccugggcuuuauuaugugggcgugccaaaaagggaauaucagauguaacaucugcauuuga

SEQ ID NO: 192874 - RNA, 1701 nt, Artificial Sequence; identical to SEQ ID NO: 192861
  derived and/or modified sequence opt5 from hemagglutinin__InfluenzaA__AGE89422

SEQ ID NO: 192875 - RNA, 1701 nt, Artificial Sequence; identical to SEQ ID NO: 191358
  derived and/or modified sequence opt5 from hemagglutinin__InfluenzaA__AGE89719

SEQ ID NO: 192876 - RNA, 1701 nt, Artificial Sequence
  derived and/or modified sequence opt5 from hemagglutinin__InfluenzaA__AGE89730
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagaacauccacccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaucaccagaacggccaagggucuggauacgcugcggaccuuaagagcacacagaaugccaucgauaaaaucaccaacaaggucaauuccgugauugaaaagaugaacacgcaguuuacagcuguuggcaaagaguucaaucaccuggagaagcgcaucgaaaaccucaauaaaaagguggacgauggguuccuggacauuuggaccuacaacgccgagcugcucguccugcuugaaaaugagagaacccuggauuaucaugacagcaacgugaaaaaccucuacgaaaagguccggucucagcugaagaauaacgccaaagagaucggaaauggcuguuuugaguucuaucacaagugcgauaacacauguauggaauccgugaaaaaugggaccuacgacuauccuaaguacagcgaggaagcuaaacuuaaccgcgaggaaauugauggcguuaagcuggagucuacaagaaucuaucaaauccucgccauuuacuccacgguggcgagcucccugguccuggugguuucucucggagcuaucagcuuuuggaugugcuccaauggcucucugcagugccggauuuguaucuga

SEQ ID NO: 192877 - RNA, 1701 nt, Artificial Sequence; identical to SEQ ID NO: 191375
  derived and/or modified sequence opt5 from hemagglutinin__InfluenzaA__AGE89740

SEQ ID NO: 192878 - RNA, 1701 nt, Artificial Sequence
  derived and/or modified sequence opt5 from hemagglutinin__InfluenzaA__AGE89751
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccggcgagaucugcgacucuccgcaccauauccuugauggggaaaauuguacacugauugacgcccuccugggagauccccagugcgacggcuuucagaacaaaaagugggaucuguucgucgagagaagccgggcuuauuccaauuguuacccuuaugacgugcccgauuacgccucucuccgcagccugguugcuuccagcgggacccuugaauuuaacaaugagucuuucaacuggacgggagugacccaaaauggcacauccagcgccugcaucagacggucuaacaauuccuuuuucagccgccugaacuggcucacccaccugaauuuuaaauauccugcgcuuaacgucacaaugcccaacaaugagcaguucgacaagcuguacauuuggggcgugcaucacccugggaccgauaaggaccagaucuuucucuaugcccaggcuucuggaagaauuacgguuuccacaaaacggagccaacaggccgugaucccgaacauuggcucccgccccagaguccggaauaucccuucucgcaucagcauuuacuggaccaucgugaagcccggggauauucugcugaucaacuccacaggaaaucucauugcuccuagaggcuacuucaaaauccggagcgggaagucuuccaucaugcgcagcgacgcccccauuggaaaauguaacucugaaugcaucaccccgaauggcagcauuccuaacgacaagcccuuucagaaugugaacagaaucaccuauggcgcguguccucgguacgucaagcaguccacacugaaacuugccacggggaugcgcaauguucccgagaagcaaaccagaggaauuuucggcgcuaucgccggguuuaucgaaaacggaugggagggcaugauggaugggugguauggauuccggcaccaaaauucugagggcagaggccaggcugccgaccugaaaagcacacaggccgcuauugaucagaucaacgggaagcucaaucgccugauuggaaaaaccaacgaaaaguuccaucagaucgagaaagaauuuuccgagguggaaggccggauucaggaccuugagaaguacguggaggauacaaagaucgaccuguggagcuauaacgcggaacuccuggucgccauggagaaucaacacaccauugaucugacggacucugaaaugaacaaacucuucgagaagaccaaaaagcagcugagagaaaaugcugaggauauggggaacggaugcuuuaaaaucuaccauaagugugacaaugccugcaucggcuccauucgcaacgggacauaugaucacgacguguaccgggacgaggcccuuagcaauagauuccagaucaagggcguugaacugaaaucuggauacaaggauuggauucucuggaucuccuuugcuauuagcugcuuccugcuuuguguggcccugcucggcuuuaucaugugggcgugccagaaagggaacauccgcuguaauauuugcaucuga

SEQ ID NO: 192879 - RNA, 1701 nt, Artificial Sequence; identical to SEQ ID NO: 191378
  derived and/or modified sequence opt5 from hemagglutinin__InfluenzaA__AGE89762

SEQ ID NO: 192880 - RNA, 1701 nt, Artificial Sequence
  derived and/or modified sequence opt5 from hemagglutinin__InfluenzaA__AGF44891
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccauggaacgcaaugcugggagcggaauuaucaucucugacacacccgugcaugauugcaacaccaccugucaaacaccugagggcgccauuaauacgucccuccccuuccagaacauccacccgauuaccaucggcaaaugcccuaaguaugucaagagcacaaaacugagacuugcuaccgggcugcggaaugugcccucuauucagagccgcggacucuuuggcgccaucgccggguucaucgaaggaggcuggacagggaugguugacggaugguacggcuaucaucaccagaacgagcaaggcuccggguacgcugcggaccugaagucuacccagaaugccguggauaaaauuacgaacaaggucaauagcgugaucgagaaaaugaacacacaguuuaccgcuguuggaaaggaguucaaucaccuugagaagagaauugaaaaccugaauaaaaagguggacgauggcuuccucgacaucuggaccuacaacgccgagcugcugguccuccuggaaaaugagcggacacuugauuaucaugacuccaacgugaaaaaccuguacgagaagguccgcaaucagcucaaaaacaaugccaaggaaauugggaacggauguuuugaguucuaucacaagugcgauaauaccuguauggaaagcgugaaaaacggcacauacgacuauccuaaguacucugaggaagcuaaacugaauagagagaagaucgaugggguuaaacuugaguccacgcggaucuaucaaauucuggccaucuacagcaccguggcgucuucccucguccuggugguuagccugggcgcuauuuccuuuuggaugugcucuaacggaagccuccagugccgcaucuguauuuga

SEQ ID NO: 192881 - RNA, 1701 nt, Artificial Sequence; identical to SEQ ID NO: 192880
  derived and/or modified sequence opt5 from hemagglutinin__InfluenzaA__AGF44892

SEQ ID NO: 192882 - RNA, 1701 nt, Artificial Sequence
  derived and/or modified sequence opt5 from hemagglutinin__InfluenzaA__AGF44895
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaucagcugcuuccuucuguguguggcccuccugggcuuuauuaugugggcuugccagaaagggaauauccgcuguaacauuugcaucuga

SEQ ID NO: 192883 - RNA, 1701 nt, Artificial Sequence; identical to SEQ ID NO: 192859
  derived and/or modified sequence opt5 from hemagglutinin__InfluenzaA__AGF44896

SEQ ID NO: 192884 - RNA, 1701 nt, Artificial Sequence
  derived and/or modified sequence opt5 from hemagglutinin__InfluenzaA__AGF44897
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcaugcgcagaucuaacaauuccuuuuucagccggcugaacuggcucacacaccugaauuuuaaauacccugcccuuaacgucaccaugcccaacaaugaacaguucgacaagcuguauaucuggggcgugcaucacccugggacggauaaggaccagauuuuucucuacgcgcaagccucuggacgcaucacaguuuccaccaaaagaagccagcaggcugugauuccgaacaucggcucccggccccgcgucagaaauauuccuucucgggugagcaucuauuggacaaucgugaagcccggggauauucugcugaucaacuccaccggaaaucucauugccccucgcggcuacuucaaaauccagagcgggaagucuuccauuaugagaagcgacgcucccaucggaaaauguaacucugccugcaucaccccgaauggcagcauuccuaacgacaagcccuuucaaaaugucaaccggaucacauacggcgcguguccucgcuauguuaagcagaauacgcugaaacuugccaccgggaugagaaacgugcccgagaagcagacacggggaauuuucggcgcuaucgccggguuuauugaaaauggaugggagggcaugguggaugggugguacggauuccgccaccaaaacuccgagggcagaggccaggcugccgaccugaaaucuacccaggccgcuaucgaucagaucaaugggaagcucaaccggcugauuggaaaaacaaacgaaaaguuccaucaaaucgagaaagaauuuagcgaggucgaaggccgcauucaggaccuugagaaguauguggaggauaccaagaucgaccugugguccuacaaugcggaacuccugguugcccuggagaaccagcacacgauugaucucacagacagcgaaaugaauaaacuguucgagaagaccaaaaagcagcuuagagaaaacgcugaggauauggggaauggaugcuuuaaaaucuaucauaagugugacaacgccugcauuggcucuauccggaaugggaccuacgaucacgacguguauagagacgaggcccugaacaaucgcuuccaaaucaagggcgucgaacucaaauccggauacaaggauuggauucuguggaucagcuuugcuauuucuugcuuccuucuguguguggcccuccugggcuuuaucaugugggcgugccagaaagggaacauucgguguaauaucugcaucuga

SEQ ID NO: 192885 - RNA, 1701 nt, Artificial Sequence; identical to SEQ ID NO: 192882
  derived and/or modified sequence opt5 from hemagglutinin__InfluenzaA__AGF44900

SEQ ID NO: 192886 - RNA, 1701 nt, Artificial Sequence; identical to SEQ ID NO: 192882
  derived and/or modified sequence opt5 from hemagglutinin__InfluenzaA__AGF44901

SEQ ID NO: 192887 - RNA, 1701 nt, Artificial Sequence; identical to SEQ ID NO: 192882
  derived and/or modified sequence opt5 from hemagglutinin__InfluenzaA__AGF44902

SEQ ID NO: 192888 - RNA, 1701 nt, Artificial Sequence; identical to SEQ ID NO: 192882
  derived and/or modified sequence opt5 from hemagglutinin__InfluenzaA__AGF44903

SEQ ID NO: 192889 - RNA, 1701 nt, Artificial Sequence; identical to SEQ ID NO: 192882
  derived and/or modified sequence opt5 from hemagglutinin__InfluenzaA__AGF44904

SEQ ID NO: 192890 - RNA, 1701 nt, Artificial Sequence
  derived and/or modified sequence opt5 from hemagglutinin__InfluenzaA__AGF44905
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaacaccuauggcgcuuguccucgguacgugaagcagucuacacugaaacuugccacggggaugcgcaauguccccgagaagcaaaccagaggaaucuucggcgcgaucgccggguuuauugaaaacggaugggagggcaugguugaugggugguauggauuccggcaccagaauagcgagggcagaggccaggcugccgaccugaaauccacacaagcugccaucgaucagauuaacgggaagcucaaucgccugaucggaaaaaccaacgaaaaguuccaccagauugagaaggaauuuagcgagguggaaggccggauccaggaccuugagaaauacguggaggauacaaagauugaccuguggucuuauaacgccgaacuccuggucgcucuggagaaucaacauaccaucgaucucacggacuccgaaaugaacaaacuguucgagaagaccaaaaagcagcuuagagaaaaugcggaggauauggggaacggaugcuuuaagaucuaccacaaaugugacaaugccugcauuggcagcauccgcaacgggacauaugaucauaauguguaccgggacgaggcucugaacaauagauuccagauuaagggcguugaacucaaaucuggauacaaggacuggauccuguggauuuccuuugccaucagcugcuuccuucuguguguggcccuccugggcuuuaucaugugggcuugccagaaagggaacauucgcuguaauaucugcauuuga

SEQ ID NO: 192891 - RNA, 1701 nt, Artificial Sequence; identical to SEQ ID NO: 192882
  derived and/or modified sequence opt5 from hemagglutinin__InfluenzaA__AGF44906

SEQ ID NO: 192892 - RNA, 1701 nt, Artificial Sequence
  derived and/or modified sequence opt5 from hemagglutinin__InfluenzaA__AGF44908
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugauggauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguugaagggcgcauucaggaccuugagaaauacguggaggauaccaagaucgaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacgucuaccgcgacgaggcccugaacaaucgguuccagaucaagggaguggaacucaaaucuggcuacaaggauuggauucuguggaucuccuuugccaucagcugcuuccuucuguguguugcucuccugggguuuauuaugugggccugccagaaaggaaacaucagauguaauauuugcaucuga

SEQ ID NO: 192893 - RNA, 1701 nt, Artificial Sequence; identical to SEQ ID NO: 192882
  derived and/or modified sequence opt5 from hemagglutinin__InfluenzaA__AGF44909

SEQ ID NO: 192894 - RNA, 1701 nt, Artificial Sequence; identical to SEQ ID NO: 192882
  derived and/or modified sequence opt5 from hemagglutinin__InfluenzaA__AGF44910

SEQ ID NO: 192895 - RNA, 1701 nt, Artificial Sequence
  derived and/or modified sequence opt5 from hemagglutinin__InfluenzaA__AGF44911
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaccagcugcuuccuucuguguguggcucuccugggguuuaucaugugggccugccagaaaggaaacauuagauguaauaucugcauuuga

SEQ ID NO: 192896 - RNA, 1701 nt, Artificial Sequence; identical to SEQ ID NO: 192882
  derived and/or modified sequence opt5 from hemagglutinin__InfluenzaA__AGF44912

SEQ ID NO: 192897 - RNA, 1701 nt, Artificial Sequence; identical to SEQ ID NO: 192882
  derived and/or modified sequence opt5 from hemagglutinin__InfluenzaA__AGF44913

SEQ ID NO: 192898 - RNA, 1701 nt, Artificial Sequence
  derived and/or modified sequence opt5 from hemagglutinin__InfluenzaA__AGF44914
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauaagaucaccuauggcgcuuguccuagauacgugaaacagucuacacugaaacuugccacggggaugcggaacguccccgagaagcaaacccgcggaaucuucggcgcgauugccggguuuaucgaaaauggaugggagggcaugguugaugggugguauggauucagacaccagaacagcgagggccggggccaggcugccgaccugaaguccacacaagcugccauugaucagaucaaugggaaacucaacagacugauuggaaagaccaaugaaaaguuccaccagaucgagaaagaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaagcagcuucgggaaaacgcggaggauauggggaauggaugcuuuaaaauuuaccacaagugugacaacgccugcaucggcagcauuagaaaugggaccuaugaucauaacguguaccgcgacgaggcucugaauaaccgguuccagaucaaaggcguugaacucaagucuggauacaaagacuggauucuguggaucuccuuugccaucagcugcuuccuucuguguguggcccuccugggcuuuauuaugugggcuugccagaaggggaauaucagauguaacauuugcaucuga

SEQ ID NO: 192899 - RNA, 1701 nt, Artificial Sequence; identical to SEQ ID NO: 192859
  derived and/or modified sequence opt5 from hemagglutinin__InfluenzaA__AGF44916

SEQ ID NO: 192900 - RNA, 1701 nt, Artificial Sequence
  derived and/or modified sequence opt5 from hemagglutinin__InfluenzaA__AGF44917
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugagcaaaucgaagugacaaacgcuaccgagcucgugcagucuagcuccacaggcgaaaucugcaauucuccgcaccagauucuggauggggagaacuguacccuuaucgacgcccugcucggagauccccagugcgacggcuuucaaaauaaaaagugggaucuguucgucgaaagaagcaaagccuauuccaacuguuacccuuaugacgugcccgauuacgcuucucugcggagccucguugccuccagcgggacgcuggaguuuaauaacgagucuuucaauuggaccggagugacacagaacggcaccuccagcgcuugcauucgcggcucugacuccagcuuuuucucuagacuuaauuggcugacacaucucaacuuuaaguauccugcccugaaugucaccaugcccaacaacgaacaguucgauaagcuguacaucuggggagugcaccauccugggacggacaaagaucagauuuuucuguaugcgcaagccuccggccggaucacaguuagcaccaagcgcucccagcaggcugugauuccgaauaucgggucuagaccccggauccgcaacauuccuagcagaaucuccauuuacuggacaaucgucaaacccggagacauucuccugaucaauagcaccggcaaccugaucgccccucggggguacuucaagauucgcucuggaaaauccagcaucaugagaucugaugcucccauuggcaaguguaauagcgagugcaucaccccgaacggcuccauuccuaaugacaagcccuuucagaacgugaaucggaucacauauggggccuguccucgcuacgugaaacaaaacacgcucaagcuggcgaccggaaugagaaauguccccgaaaaacagacacggggcaucuucggggccauugcuggauuuaucgagaacggcugggaggggaugauggacggaugguauggcuuccgccaccaaaauucugaaggcagagggcaggccgcugaucuuaagagcacccaggccgccauugaccagaucaacggaaaacugaaucggcucauuggcaagacaaacgagaaauuccaccagaucgaaaaggaguuuuccgaaguugaggggcgcauucaagaucuggagaaguacguggaagacaccaaaaucgaucuuuggagcuauaacgcugagcugcucguggcgcuggaaaaucagcauacgaucgaccugacagauucugagaugaacaaacucuucgaaaagaccaagaaacagcugagagagaaugccgaggacaugggaaacggcugcuuuaagauuuaccacaagugugauaaugcuugcaucggguccauucggaacggcaccuauaaucaugacgucuacagagaugaagcccuuaacaaucgcuuccagaucaaaggaguggagcuuaagagcggcuacaaagacuggauucucuggaucucuuuugccaucuccugcuuccugcuuuguguugcucugcucggguuuauuaugugggccugccaaaagggaaacauccgguguaauauuugcaucuga

SEQ ID NO: 192901 - RNA, 1701 nt, Artificial Sequence; identical to SEQ ID NO: 192859
  derived and/or modified sequence opt5 from hemagglutinin__InfluenzaA__AGF44918

SEQ ID NO: 192902 - RNA, 1701 nt, Artificial Sequence
  derived and/or modified sequence opt5 from hemagglutinin__InfluenzaA__AGF44919
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucauuacguguaccgcgacgaggcccugaacaaucgguuccagaucaagggaguugaacucaaaucuggcuauaaggacuggauucuguggaucuccuuugccaucagcugcuuccuucuguguguggcucuccugggguuuauuaugugggccugccagaaaggaaacaucagauguaauauuugcaucuga

SEQ ID NO: 192903 - RNA, 1701 nt, Artificial Sequence; identical to SEQ ID NO: 192859
  derived and/or modified sequence opt5 from hemagglutinin__InfluenzaA__AGF44920

SEQ ID NO: 192904 - RNA, 1701 nt, Artificial Sequence; identical to SEQ ID NO: 192882
  derived and/or modified sequence opt5 from hemagglutinin__InfluenzaA__AGF44921

SEQ ID NO: 192905 - RNA, 1701 nt, Artificial Sequence
  derived and/or modified sequence opt5 from hemagglutinin__InfluenzaA__AGG13411
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgacagaauugaagugacaaaugcuaccgagcuggugcaaucuagcuccacaggcgaaaucugcaacucuccgcaccagauccuugauggggagaauuguacccugauugacgcccuccugggagauccccagugcgacggcuuucagaacaagaaaugggaucuguucgucgaacggagcaaggcccauuccaauuguuauccuuacgacgugcccgauuaugcuucucuccgcagccugguugccuccagcgggacgcuugaguuuaacaaugagucuuucaacuggaccggagugacacaaaauggcaccuccagcgcuugcaucagacggucuaacaauuccuuuuucagccgccugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaggccucuggaagaauuacaguuuccaccaaacggaaccaacagacagugaucccgaauauuggcagccgccccagaguccggaacaucccuucccgcgugucuaucuauuggaccauugugaagcccggggauauccugcugauuaauagcaccggaaaccucaucgcuccuagaggcuacuucaaaauucgguccggaaagagcucuaucaugcgcuccgacgcccccaucgggaaauguaauagcgcuugcauuacaccgaacggcucuaucccuaaugacaagcccuuucagaacgucaauagaauuacguacggcgccuguccucgguauguuaagcagaacacccugaaacuugcgacagggaugcgcaaugugcccgagaagcaaaccagaggaaucuucggcgccauugcuggguuuaucgaaaacggaugggagggcaugguggaugggugguacggauuccggcaccagaauagcgagggcagaggccaggccgcugaccugaaauccacacaagccgccaucgaucagauuaacgggaagcucaaccgccugaucggaaaaaccaaugaaaaguuccaucagauugagaaagaauuuucugaggucgaaggccggauccaggaccuugagaaguauguggaggauacgaagauugaccuguggagcuacaacgcugaacuccugguugcgcuggagaaucaacacacaaucgaucucaccgacuccgaaaugaacaaacuguucgagaagaccaaaaagcagcuuagagaaaaugccgaggauauggggaacggaugcuuuaaaauuuaucauaagugugacaaugcuugcaucggcagcauccgcaacgggacauacgaucacgacguguaucgggacgaggcccugaauaacagauuccagauuaagggcgucgaacucaaaucuggauacaaggauuggauccuguggauuuccuuugccaucagcugcuuccuucuguguguggcucuccugggcuuuauuaugugggccugccagaaagggaauauccgcuguaacaucugcauuuga

SEQ ID NO: 192906 - RNA, 1701 nt, Artificial Sequence
  derived and/or modified sequence opt5 from hemagglutinin__InfluenzaA__AGG13447
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgacagaauugaagugacaaaugcuaccgagcuggugcaaucuagcuccacaggcgaaaucugcaacucuccgcaccagauccuugauggggagaauuguacccugauugacgcccuccugggagauccccagugcgacggcuuucagaacaagaaaugggaucuguucgucgaacggagcaaggcccauuccaauuguuauccuuacgacgugcccgauuaugcuucucuccgcagccugguugccuccagcgggacgcuugaguuuaacaaugagucuuucaacuggaccggagugacacaaaauggcaccuccagcgcuugcaucagacggucuaacaauuccuuuuucagccgccugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaggccucuggaagaauuacaguuuccaccaaacggagccaacagacagugaucccgaacauuggcucccgccccagaguccggaauaucccuucucgcgugagcaucuauuggaccauugugaagcccggggauauccugcugauuaacuccaccggaaaucucaucgcuccuagaggcuacuucaaaauucggagcgggaagucuuccaucaugcgcagcgacgcccccaucggaaaauguaacucugcuugcauuacaccgaauggcagcaucccuaacgacaagcccuuucagaaugucaacagaauuacguacggcgccuguccucgguauguuaagcagaauacccugaaacuugcgacagggaugcgcaacgugcccgagaagcaaaccagaggaaucuucggcgccauugcuggguuuaucgaaaauggaugggagggcaugguggaugggugguacggauuccggcaccagaacuccgagggcagaggccaggccgcugaccugaaaucuacacaagccgccaucgaucagauuaaugggaagcucaaccgccugaucggaaaaaccaacgaaaaguuccaucagauugagaaagaauuuagcgaggucgaaggccggauccaggaccuugagaaguauguggaggauacgaagauugaccugugguccuacaaugcugaacuccugguugcgcuggagaaccaacacacaaucgaucucaccgacagcgaaaugaauaaacuguucgagaagacccagaaacagcuuagagaaaacgccgaggauauggggaauggaugcuuuaagauuuaucauaaaugugacaacgcuugcaucggcucuauccgcaaugggacauacgaucacgacguguaucgggacgaggcccugaacaauagauuccagauuaagggcgucgaacucaaguccggauacaaagauuggauccuguggauuagcuuugccaucucuugcuuccuucuguguguggcucuccugggcuuuauuaugugggccugccaaaaggggaacauccgcuguaauaucugcauuuga

SEQ ID NO: 192907 - RNA, 1701 nt, Artificial Sequence
  derived and/or modified sequence opt5 from hemagglutinin__InfluenzaA__AGG13459
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucaugacguguaccgggacgaggcucugaacaauagauuccagaucaagggcguugaacucaaaucuggauacaaggauuggauucuguggaucuccuuugccaucagcugcuuccuucuguguguggcccuccugggcuuuauuaugugggcuugccagaaagggaacauccgcuguaauauuugcaucuga

SEQ ID NO: 192908 - RNA, 1701 nt, Artificial Sequence
  derived and/or modified sequence opt5 from hemagglutinin__InfluenzaA__AGG13495
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcagucugugaucccgaacauuggcagccggccccgcaucagaaauaucccuucccggauuagcaucuacuggacaauugucaaacccggggacauccugcugauuaacucuaccggaaaucucaucgcuccucgcggcuacuucaagauccaguccgggaaaagcucuauuaugagaagcgacgcccccaucggaaaguguaacuccgaaugcauuaccccgaauggcucuaucccuaacgauaagcccuuucaaaaugugaaccggauuacauauggcgcuuguccucgcuacgugaaacagaauacgcugaaacuugccaccgggaugagaaacguccccgagaagcagacacggggaaucuucggcgcgaucgccggguuuauugaaaauggaugggagggcaugguugacgggugguauggauuccgccaccaaaacagcgagggcagaggccaggcugccgaucugaaguccacccaggcugccaucgaccagauuaaugggaaacucaaccggcugaucggaaagacaaaugaaaaauuccaccaaauugagaaggaauuuagcgagguggaaggcagaauccaggaucuugagaaguacguggaggacaccaaaauugaucuguggucuuauaacgccgaacuccuggucgcucuggagaaccagcauacgaucgaccucacagauuccgaaaugaauaagcuguucgagaaaaccaagaaacagcuucgcgaaaacgcggaggacauggggaauggaugcuuuaagaucuaccacaagugugauaacgccugcauuggcagcauccggaaugggaccuauaaccaugacguguacagagacgaggcucugaauaaccgcuuccaaauuaaaggcguugaacucaagucuggauacaaagauuggauccuguggauuuccuuugccaucagcugcuuccuucuguguguggcccuccugggcuuuaucaugugggcuugccagaaggggaauauucgguguaacaucugcauuuga

SEQ ID NO: 192909 - RNA, 1701 nt, Artificial Sequence; identical to SEQ ID NO: 192907
  derived and/or modified sequence opt5 from hemagglutinin__InfluenzaA__AGG13507

SEQ ID NO: 192910 - RNA, 1701 nt, Artificial Sequence
  derived and/or modified sequence opt5 from hemagglutinin__InfluenzaA__AGG13519
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcagucugugaucccgaacauuggcagccggccccgcaucagaaauaucccuucccggauuagcaucuacuggacaauugucaaacccggggacauccugcugauuaacucuaccggaaaucucaucgcuccucgcggcuacuucaagauccaguccgggaaaagcucuauuaugagaagcgacgcccccaucggaaaguguaacuccgaaugcauuaccccgaauggcucuaucccuaacgauaagcccuuucaaaaugugaaccggauuacauauggcgcuuguccucgcuacgugaaacagaauacgcugaaacuugccaccgggaugagaaacguccccgagaagcagacacggggaaucuucggcgcgaucgccggguuuauugaaaauggaugggagggcaugguugacgggugguauggauuccgccaccaaaacagcgagggcagaggccaggcugccgaucugaaguccacccaggcugccaucgaccagauuaaugggaaacucaaccggcugaucggaaagacaaaugaaaaauuccaccaaauugagaaggaauuuagcgagguggaaggcagagugcaggaucuugagaaguacgucgaggacaccaaaaucgaucuguggucuuauaacgccgaacuccugguggcucuggagaaccagcauacgauugaccucacagauuccgaaaugaauaagcuguucgagaaaaccaagaaacagcuucgcgaaaacgcggaggacauggggaauggaugcuuuaagaucuaccacaagugugauaacgccugcaucggcagcauucggaaugggaccuauaaccaugacguuuacagagacgaggcucugaauaaccgcuuccaaaucaaaggcguggaacucaagucuggauacaaagauuggauucuguggaucuccuuugccauuagcugcuuccuucugugugucgcccuccugggcuuuaucaugugggcuugccagaaggggaauauccgguguaacauuugcaucuga

SEQ ID NO: 192911 - RNA, 1701 nt, Artificial Sequence; identical to SEQ ID NO: 192907
  derived and/or modified sequence opt5 from hemagglutinin__InfluenzaA__AGG13531

SEQ ID NO: 192912 - RNA, 1701 nt, Artificial Sequence
  derived and/or modified sequence opt5 from hemagglutinin__InfluenzaA__AGG13543
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggacaucgagaaauacguggaggauacaaagaucgaccuuuggucuuauaacgccgaacugcucgucgcucuggagaaccaacauaccauugaucugacggacuccgaaaugaauaaacucuucgagaagaccaaaaagcagcugagagaaaacgcggaggauauggggaauggaugcuuuaagaucuaccacaaaugugacaacgccugcauuggcagcauccgcaaugggacauaugaucauaacguguaccgggacgaggcucuuaauaacagauuccagauuaagggcguugaacugaaaucuggauacaaggacuggauccucuggaucuccuuugccauuagcugcuuccugcuuuguguggcccugcucggcuuuaucaugugggcuugccagaaagggaauauucgcuguaacaucugcauuuga

SEQ ID NO: 192913 - RNA, 1701 nt, Artificial Sequence; identical to SEQ ID NO: 192907
  derived and/or modified sequence opt5 from hemagglutinin__InfluenzaA__AGG13555

SEQ ID NO: 192914 - RNA, 1701 nt, Artificial Sequence; identical to SEQ ID NO: 192907
  derived and/or modified sequence opt5 from hemagglutinin__InfluenzaA__AGG13567

SEQ ID NO: 192915 - RNA, 1701 nt, Artificial Sequence
  derived and/or modified sequence opt5 from hemagglutinin__InfluenzaA__AGG13591
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagaauuucaacuggacgggagugacccaaaauggcacaagcucugcuugcauuagacgguccaacagcuccuuuuucucucgccugaauuggcucacccaucugaacuuuaaguauccugcccuuaacgucacaaugcccaauaacgagcaguucgacaagcuguacaucuggggcgugcaccauccugggaccgauaaagaccagauuuuucucuaugcgcagagcucuggaagaaucacgguuuccacaaagcggagccaacaggccgugauuccgaauaucggcucccgccccagaauccggaacauuccuucucgcaucagcauuuacuggaccaucgucaaacccggggauauucugcugaucaauuccacaggaaaccucaucgcuccuagaggcuacuucaagauucggagcgggaaaucuuccaucaugcgcagcgacgcccccauuggaaaguguaagucugaaugcaucaccccgaauggcagcauuccuaacgacagacccuuucagaaugugaaccggaucaccuauggcgcuuguccucgcuacgugaaacaguccacacugaagcuggccacggggaugagaaauguccccgagaaacaaacccggggaaucuucggcgcgauugccggguuuaucgaaaacggaugggagggcaugguugaugggugguauggauucagacaccaaaauucugagggccgcggccaggcugccgaccuuaagagcacacaggcugccauugaucagaucaacgggaaacucaaucggcugauuggaaagaccaacgaaaaauuccaccagaucgagaaggaauuuuccgagguggaaggccgcauucaggaccuugagaaguacguggaggauacaaaaaucgaccuguggagcuauaacgccgaacuccuggucgcucuggagaaucaacauaccaucgaucucacggacucugaaaugaacaagcuguucgagaaaacaaagaaacagcuuagagaaaaugcggaggauauggggaacggaugcuuuaagauuuaccacaagugugacaaugccugcaucggcuccauucggaacgggaccuaugaucaugacguguacagagacgaggcucugaauaaccgcuuccagaucaaaggcguugaacucaagagcggauacaaagauuggauucuguggaucucuuuugccaucuccugcuuccuucuguguguggcccuccugggcuuuauuaugugggcuugccagaaggggaauauccgguguaacauuugcaucuga

SEQ ID NO: 192916 - RNA, 1701 nt, Artificial Sequence
  derived and/or modified sequence opt5 from hemagglutinin__InfluenzaA__AGG13615
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauucuuccuuuuucagccgccuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcagucuuccggaagaauuacgguuagcacaaagcggucccaacaggccgugaucccgaacaucggcucucgcccccggauuagaaauaucccuagccgcauuuccaucuacuggaccauugucaaacccggggauauccuccugaucaacagcacaggaaaucugauugcuccuagaggcuacuucaagauccggucugggaaauccagcauuaugcgcucugacgcccccaucggaaaguguaagagcgaaugcauuaccccgaacggcuccaucccuucugacaaacccuuucagaaugugaacagaaucaccuauggcgcuuguccucgguacgugaagcagagcacacucaaacuggccacggggaugcgcaauguccccgagaagcaaaccagaggaauuuucggcgcgaucgccggguuuauugaaaacggaugggagggcaugguugaugggugguauggauuccggcaccaaaauuccgagggcagaggccaggcugccgaccuuaaaagcacacaggcugccaucgaucagauuaacgggaagcugaaucgccucaucggaaaaaccaacgaaaaguuccaccagauugagaaggaauuuucugagguggaaggccggauccaggaccuggagaaauacguggaggauacaaagaucgaccuuugguccuauaaugccgaacugcucgucgcucuggagaaccaacauaccauugaucugacggacagcgaaaugaacaaacucuucgagaagacaaagaagcagcugagagaaaaugcggaggauauggggaacggaugcuuuaagaucuaccacaaaugugacaaugccugcauuggcucuauccgcaacgggaccuaugaucaugacguguaccgggacgaggcucuuaauaacagauuccagauuaagggcguugaacugaaauccggauacaaggauuggauccucuggaucagcuuugccauuuccugcuuccugcuuuguguggcccugcucggcuuuaucaugugggcuugccagaaagggaauauucgcuguaacaucugcauuuga

SEQ ID NO: 192917 - RNA, 1701 nt, Artificial Sequence; identical to SEQ ID NO: 192915
  derived and/or modified sequence opt5 from hemagglutinin__InfluenzaA__AGG13627

SEQ ID NO: 192918 - RNA, 1701 nt, Artificial Sequence
  derived and/or modified sequence opt5 from hemagglutinin__InfluenzaA__AGG13639
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacaaacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugaugcucccauuggcaaguguaagagcgaaugcaucacaccgaauggcuccauuccuaacgacaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaacgcugaacuccuggucgcgcuggagaaucaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugauguguaccgcgacgaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 192919 - RNA, 1701 nt, Artificial Sequence; identical to SEQ ID NO: 192908
  derived and/or modified sequence opt5 from hemagglutinin__InfluenzaA__AGG13651

SEQ ID NO: 192920 - RNA, 1701 nt, Artificial Sequence; identical to SEQ ID NO: 192907
  derived and/or modified sequence opt5 from hemagglutinin__InfluenzaA__AGG13663

SEQ ID NO: 192921 - RNA, 1701 nt, Artificial Sequence; identical to SEQ ID NO: 192908
  derived and/or modified sequence opt5 from hemagglutinin__InfluenzaA__AGG13675

SEQ ID NO: 192922 - RNA, 1701 nt, Artificial Sequence; identical to SEQ ID NO: 192907
  derived and/or modified sequence opt5 from hemagglutinin__InfluenzaA__AGG13687

SEQ ID NO: 192923 - RNA, 1701 nt, Artificial Sequence; identical to SEQ ID NO: 192908
  derived and/or modified sequence opt5 from hemagglutinin__InfluenzaA__AGG13711

SEQ ID NO: 192924 - RNA, 1701 nt, Artificial Sequence; identical to SEQ ID NO: 192907
  derived and/or modified sequence opt5 from hemagglutinin__InfluenzaA__AGG13723

SEQ ID NO: 192925 - RNA, 1701 nt, Artificial Sequence; identical to SEQ ID NO: 192907
  derived and/or modified sequence opt5 from hemagglutinin__InfluenzaA__AGG13735

SEQ ID NO: 192926 - RNA, 1701 nt, Artificial Sequence; identical to SEQ ID NO: 192907
  derived and/or modified sequence opt5 from hemagglutinin__InfluenzaA__AGG13747

SEQ ID NO: 192927 - RNA, 1701 nt, Artificial Sequence
  derived and/or modified sequence opt5 from hemagglutinin__InfluenzaA__AGG13759
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgacagaauugaagugacaaaugcuaccgagcuggugcaaucuagcuccacaggcgaaaucugcaacucuccgcaccagauccuugauggggagaauuguacccugauugacgcccuccugggagauccccagugcgacggcuuucagaacaagaaaugggaucuguucgucgaacggagcaaggcccauuccaauuguuauccuuacgacgugcccgauuaugcuucucuccgcagccugguugccuccagcgggacgcuugaguuuaacaaugagucuuucaacuggaccggagugacacaaaauggcaccuccagcgcuugcaucagacggucuaacaauuccuuuuucagccgccugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaggccucuggaagaauuacaguuuccaccaaacggagccaacagacagugaucccgaacauuggcucccgccccagaguccggaauaucccuucucgcgugagcaucuauuggaccauugugaagcccggggauauccugcugauuaacuccaccggaaaucucaucgcuccuagaggcuacuucaaaauucggagcgggaagucuuccaucaugcgcagcgacgcccccaucggaaaauguaacucugcuugcauuacaccgaauggcagcaucccuaacgacaagcccuuucagaaugucaacagaauuacguacggcgccuguccucgguauguuaagcagaauacccugaaacuugcgacagggaugcgcaacgugcccgagaagcaaaccagaggaaucuucggcgccauugcuggguuuaucgaaaauggaugggagggcaugguggaugggugguacggauuccggcaccagaacuccgagggcagaggccaggccgcugaccugaaaucuacacaagccgccaucgaucagauuaaugggaagcucaaccgccugaucggaaaaaccaacgaaaaguuccaucagauugagaaagaauuuagcgaggucgaaggccggauccaggaccuugagaaguauguggaggauacgaagauugaccugugguccuacaaugcugaacuccugguugcgcuggagaaccaacacacaaucgaucucaccgacagcgaaaugaauaaacuguucgagaagaccaaaaagcagcuuagagaaaacgccgaggauauggggaauggaugcuuuaaaauuuaucauaagugugacaacgcuugcaucggcucuauccgcaaugggacauacgaucacgacguguaucgggacgaggcccugaacaauagauuccagauuaagggcgucgaacucaaauccggauacaaggauuggauccuguggauuagcuuugccaucucuugcuuccuucuguguguggcucuccugggcuuuauuaugugggccugccagaaagggaacauccgcuguaauaucugcauuuga

SEQ ID NO: 192928 - RNA, 1701 nt, Artificial Sequence
  derived and/or modified sequence opt5 from hemagglutinin__InfluenzaA__AGG13771
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcagucugugaucccgaacauuggcagccggccccgcaucagaaauaucccuucccggauuagcaucuacuggacaauugucaaacccggggacauccugcugauuaacucuaccggaaaucucaucgcuccucgcggcuacuucaagauccaguccgggaaaagcucuauuaugagaagcgacgcccccaucggaaaguguaacuccgaaugcauuaccccgaauggcucuaucccuaacgauaagcccuuucaaaaugugaaccggauuacauauggcgcuuguccucgcuacgugaaacagaauacgcugaaacuugccaccgggaugagaaacguccccgagaagcagacacggggaaucuucggcgcgaucgccggguuuauugaaaauggaugggagggcaugguugacgggugguauggauuccgccaccaaaacagcgagggcagaggccaggcugccgaucugaaguccacccaggcugccaucgaccagauuaaugggaaacucaaccggcugaucggaaagacaaaugaaaaauuccaccaaauugagaaggaauuuagcgagguggaaggcagaauccaggaucuugagaaguacguggaggacaacaaaauugaucuguggucuuauaacgccgaacuccuggucgcucuggagaaucagcauaccaucgaccucacggauuccgaaaugaacaagcuguucgagaaaacaaagaaacagcuucgcgaaaaugcggaggacauggggaacggaugcuuuaagaucuaccacaagugugauaaugccugcauuggcagcauccggaacgggaccuauaaucaugacguguacagagacgaggcucugaacaaucgcuuccaaauuaaaggcguugaacucaagucuggauacaaagauuggauccuguggauuuccuuugccaucagcugcuuccuucuguguguggcccuccugggcuuuaucaugugggcuugccagaaggggaacauucgguguaauaucugcauuuga

SEQ ID NO: 192929 - RNA, 1701 nt, Artificial Sequence
  derived and/or modified sequence opt5 from hemagglutinin__InfluenzaA__AGG13783
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaugggcgagaucugcgacuccccgcaccagauccuugauggggaaaacuguacacugauugacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauccgcggcagcaauucuuccuuuuucagcagacugaacuggcucacacaucugaauuuuaaguauccugcgcuuaacgucaccaugcccaacaaugagcaguucgacaagcuguacauuuggggagugcaccauccugggacagauaaagaccagaucuuucucuaugcccaaucuuccggccggauuaccguuagcacgaagcgcucccagcaggcugugaucccgaacauugggucuagaccccggauccgcaaugucccuagcagaaucuccauuuacuggacaaucgugaaacccggagauauucugcugaucaacagcaccggcaaucucauugccccucggggguacuucaagauccgcucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgucaagcaaucuacccugaaacuugcgacaggaaugagaaacguucccgagaagcagacgcggggcauuuucggggccaucgcuggauuuaucgaaaauggcugggaggggaugguggauggaugguauggcuuccgccaccagaacagcgagggcagagggcaagccgcugaccugaaauccacccaggccgccauugaucagaucaauggaaagcucaaccggcugauuggcaaaacaaaugaaaaguuccaccagaucgagaaggaauuuagcgagguggaagggcgcauucaagaccuugagaaauacgucgaggauaccaagaucgaccuguggucuuauaacgcugaacuccugguggcgcuggagaaccagcauacaauugaucucaccgacuccgaaaugaauaaacuguucgagaagacgaaaaagcagcuuagagaaaacgccgaggauaugggaaauggcugcuuuaagaucuaccacaaaugugacaacgcuugcaucgggagcauucggaauggcacauaugaucaugacguuuacagagacgaggcccugaacaaucgcuuccagaucaagggaguggaacucaaaucuggcuacaaggauuggauucuguggaucuccuuugccauuagcugcuuccuucugugugucgcucuccugggguuuaucaugugggccugccaaaaaggaaacauccgguguaauauuugcaucuga

SEQ ID NO: 192930 - RNA, 1701 nt, Artificial Sequence; identical to SEQ ID NO: 192908
  derived and/or modified sequence opt5 from hemagglutinin__InfluenzaA__AGG13795

SEQ ID NO: 192931 - RNA, 1701 nt, Artificial Sequence; identical to SEQ ID NO: 192859
  derived and/or modified sequence opt5 from hemagglutinin__InfluenzaA__AGG13807

SEQ ID NO: 192932 - RNA, 1701 nt, Artificial Sequence; identical to SEQ ID NO: 192908
  derived and/or modified sequence opt5 from hemagglutinin__InfluenzaA__AGG13819

SEQ ID NO: 192933 - RNA, 1701 nt, Artificial Sequence; identical to SEQ ID NO: 192908
  derived and/or modified sequence opt5 from hemagglutinin__InfluenzaA__AGG13831

SEQ ID NO: 192934 - RNA, 1701 nt, Artificial Sequence; identical to SEQ ID NO: 192907
  derived and/or modified sequence opt5 from hemagglutinin__InfluenzaA__AGG13855

SEQ ID NO: 192935 - RNA, 1701 nt, Artificial Sequence
  derived and/or modified sequence opt5 from hemagglutinin__InfluenzaA__AGG13867
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcaaaaucugcgacuccccgcaccagauucuugauggggagaacuguacacugauggacgcccuccugggagauccccagugcgacggcuuucagaauaagaaaugggaucuguucgucgaacggucuaaggccuauagcaacuguuacccuuaugacgugcccgauuacgcuucccuccgcucucugguugccagcuccgggacccuugaguuuaauaacgagagcuucaauuggacgggagugacccaaaacggcacaucuuccgcuugcaucagacggagcaauucuuccuuuuucagccgccugaacuggcucacccaucugaauuuuaaguauccugcccuuaacgucacaaugcccaacaaugaacaguucgacaaacuguacauuuggggcgugcaccauccugggaccgauaaggaccagaucuuucucuaugcgcagucuuccggaagaauuacgguuagcacaaaacggucccaacaggccgugaucccgaacauuggcucucgccccagaauccggaauaucccuagccgcauuuccaucuacuggaccauugucaagcccggggauauccugcugauuaacagcacaggaaaucucaucgcuccuagaggcuacuucaaaauccggucugggaaguccagcauuaugcgcucugacgcccccaucggaaaguguaaaagcgagugcauuaccccgaacggcuccaucccuaaugacaagcccuuucagaacgugaauagaauuaccuauggcgcuuguccucgguacgugaaacagucuacacugaaacuugccacggggaugcgcaacguccccgaaaaacaaaccagaggaaucuucggcgcgaucgccggguuuauugagaauggaugggaaggcaugguugaugggugguauggauuccggcaccagaacagcgagggcagaggccaggcugccgaccugaaguccacacaagcugccaucgaucagauuaaugggaaacucaaccgccugaucggaaagaccaaugagaaguuccaccagauugaaaaagaguuuagcgaaguggagggccggauccaggaccuugaaaaguacguggaggauacaaaaauugaccuguggucuuauaacgccgagcuccuggucgcucuggaaaaccaacauaccaucgaucucacggacuccgagaugaauaagcuguucgaaaagacaaagaagcagcuuagagagaacgcggaagauauggggaauggaugcuuuaaaaucuaccacaagugugacaacgccugcauuggcagcauccgcaaugggaccuaugaucauaacguguaccgggacgaggcucugaauaacagauuccagauuaaaggcguugagcucaagucuggauacaaagacuggauccuguggauuuccuuugccaucagcugcuuccuucuguguguggcccuccugggcuuuaucaugugggcuugccagaaggggaauauucgcuguaacaucugcauuuga

SEQ ID NO: 192936 - RNA, 1701 nt, Artificial Sequence; identical to SEQ ID NO: 192907
  derived and/or modified sequence opt5 from hemagglutinin__InfluenzaA__AGG13879

SEQ ID NO: 192937 - RNA, 1701 nt, Artificial Sequence; identical to SEQ ID NO: 192907
  derived and/or modified sequence opt5 from hemagglutinin__InfluenzaA__AGG13891

SEQ ID NO: 192938 - RNA, 1701 nt, Artificial Sequence
  derived and/or modified sequence opt5 from hemagglutinin__InfluenzaA__AGG13903
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucugacuccagcuuuuucucucggcugaacuggcucacacaucugaauuuuaaguauccugcccuuaacgucaccaugcccaauaacgagcaguucgauaagcuguacauuuggggcgugcaccauccugggacggacaaagaucagaucuuucucuaugcgcaagccuccggacgcauuacaguuagcaccaagagaucccagcagucugugcugccgaacaucggcagccggccccgcauuagaaauaucccuucccggaucagcauuuacuggacaaucgucaaacccggggacauucugcucaucaacucuaccggaaaucugauugcuccucgcggcuacuucaagauccaguccgggaaaagcucuaucaugagaagcgacgcccccauuggaaaguguaacuccgaaugcaucaccccgaauggcucuauuccuaacgauaagcccuuucaaaaugugaaccggaucacauauggcgcuuguccucgcuacgugaaacagaauacgcuuaagcuggccaccgggaugagaaacguccccgagaaacagacacggggaauuuucggcgcgaucgccggguuuaucgaaaauggaugggagggcaugguugacgggugguauggauuccgccaccaaaacagcgagggcagaggccaggcugccgaucucaaguccacccaggcugccauugaccagaucaaugggaaacugaaccggcuuauuggaaagacaaaugaaaaauuccaccaaaucgagaaggaauuuagcgagguggaaggccgcauucaggaucuggagaaguacguggaggacaccaaaaucgaucucuggucuuauaacgccgaacugcuggucgcucucgagaaccagcauacgauugaccugacagauuccgaaaugaauaaacuuuucgagaagaccaagaaacagcugagagaaaacgcggaggacauggggaauggaugcuuuaagaucuaccacaagugugauaacgccugcaucggcagcauucggaaugggaccuauaaccaugacguguacagagacgaggcucucaauaaccgcuuccaaaucaaaggcguugaacugaagucuggauacaaagauuggauucuuuggaucuccuuugccauuagcugcuuccugcucuguguggcccugcugggcuuuaucaugugggcuugccagaaggggaauauccgguguaacauuugcaucuga

SEQ ID NO: 192939 - RNA, 1701 nt, Artificial Sequence; identical to SEQ ID NO: 192907
  derived and/or modified sequence opt5 from hemagglutinin__InfluenzaA__AGG13927

SEQ ID NO: 192940 - RNA, 1701 nt, Artificial Sequence; identical to SEQ ID NO: 192915
  derived and/or modified sequence opt5 from hemagglutinin__InfluenzaA__AGG13939

SEQ ID NO: 192941 - RNA, 1701 nt, Artificial Sequence
  derived and/or modified sequence opt5 from hemagglutinin__InfluenzaA__AGG13962
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaaggauuugagaucuuccccaagaccagcucuuggccuaaccacgacuccaauaagggcgugacagccgcuuguccccaugccggcgcgaaaucuuuuuauaagaaccugaucuggcucguuaaaaaggggaauagcuacccuaaacuguccaagagcuauauuaacgauaagggaaaagaagugcuuguccuguggggcauccaccaccccuccaccacagccgaccaacagucucucuaccagaaugcugaugccuacguguucguggggaccagccgcuauuccaagaaauuuaagccugagauugcuaucagaccgaaaguccgggaccaggagggacgcaugaacuacuauuggacgcugauugaacccggcgauaagaucacauucgaggccaccgggaaccugguugugccuagauacgcguuugccauggaacggaaugcugagagcggaauuaucaucucugacacacccgugcaugauugcaacaccaccugucaaacaccugaaggcgccauuaauacgucccuccccuuccagaacauccacccgauuaccaucggcaaaugcccuaaguaugucaagagcacaaaacugcgccuugcuaccgggcugagaaaugugcccucuauucagagccggggacucuuuggcgccaucgccggguucaucgagggaggcuggacagggaugguugacggaugguacggcuaucaucaccagaacgagcaaggcuccggguacgcugcggaccugaagucuacccagaaugccauugauaaaaucacgaacaaggugaauagcgucauugagaaaaugaacacacaguuuaccgcugugggaaaggaguucaaucaccuugaaaagcgcaucgagaaccugaauaaaaagguugacgauggcuuccucgacauuuggaccuacaacgccgaacugcuggugcuccuggagaaugagagaacacuugauuaucaugacuccaacgucaaaaaccuguacgaaaaggugcggaaucagcucaaaaacaaugccaaggagaucgggaacggauguuuugaguucuaucacaagugcgauaauaccuguauggaaagcgucaaaaacggcacauacgacuauccuaaguacucugaagaggcuaaacugaaucgcgagaagaucgauggggugaaacuugaauccacgagaauuuaucaaauccuggccauuuacagcaccguugcgucuucccucgugcuggucgugagccugggcgcuaucuccuuuuggaugugcucuaacggaagccuccagugccggauuuguaucuga

SEQ ID NO: 192942 - RNA, 1701 nt, Artificial Sequence; identical to SEQ ID NO: 192907
  derived and/or modified sequence opt5 from hemagglutinin__InfluenzaA__AGG13973

SEQ ID NO: 192943 - RNA, 1701 nt, Artificial Sequence; identical to SEQ ID NO: 192907
  derived and/or modified sequence opt5 from hemagglutinin__InfluenzaA__AGG13985

SEQ ID NO: 192944 - RNA, 1701 nt, Artificial Sequence; identical to SEQ ID NO: 192907
  derived and/or modified sequence opt5 from hemagglutinin__InfluenzaA__AGG13997

SEQ ID NO: 192945 - RNA, 1701 nt, Artificial Sequence; identical to SEQ ID NO: 192907
  derived and/or modified sequence opt5 from hemagglutinin__InfluenzaA__AGG14009

SEQ ID NO: 192946 - RNA, 1701 nt, Artificial Sequence
  derived and/or modified sequence opt5 from hemagglutinin__InfluenzaA__AGG14021
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuacauacggcgcguguccuagauauguuaagcaaaauacgcugaaacuugccaccgggaugcggaacgugcccgagaagcagacacgcggaaucuucggcgcuauugccggguuuaucgaaaauggaugggagggcaugguggaugggugguacggauucagacaccagaacuccgagggccggggccaagcugccgaccugaaaucuacccaggccgcuaucgaucagauuaaugggaagcucaacagacugaucggaaaaacaaacgaaaaguuccaucagauugagaaagaauuuagcgaggucgaaggccgcauccaagaccuugagaaguauguggaggauaccaagauugaccugugguccuacaaugcggaacuccugguugcccuggagaaccagcacacgaucgaucucacagacagcgaaaugaauaaacuguucgagaagaccaaaaagcagcuucgggaaaacgcugaggauauggggaauggaugcuuuaaaauuuaucauaagugugacaacgccugcaucggcucuaucagaaaugggaccuacgaucacgacguguaucgcgacgaggcccugaacaaucgguuccagauuaagggcaucgaacucaaauccggauacaaggauuggauucuguggaucagcuuugcuauuucuugcuuccuucugugugucgcccuccugggcuuuaucaugugggcgugccaaaaagggaacaucagauguaauauuugcaucuga

SEQ ID NO: 192947 - RNA, 1701 nt, Artificial Sequence; identical to SEQ ID NO: 192908
  derived and/or modified sequence opt5 from hemagglutinin__InfluenzaA__AGG14033

SEQ ID NO: 192948 - RNA, 1701 nt, Artificial Sequence; identical to SEQ ID NO: 192927
  derived and/or modified sequence opt5 from hemagglutinin__InfluenzaA__AGG14318

SEQ ID NO: 192949 - RNA, 1701 nt, Artificial Sequence
  derived and/or modified sequence opt5 from hemagglutinin__InfluenzaA__AGG14330
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucauucgcucugacgcccccaucggaaaguguaagagcgaaugcauuaccccgaacggcuccaucccuaaugacaaacccuuucagaacgugaauagaaucaccuauggcgcuuguccucgguacgugaagcagucuacacugaaacuugccacggggaugcgcaacguccccgagaagcaaaccagaggaauuuucggcgcgaucgccggguuuauugaaaauggaugggagggcaugguugaugggugguauggauuccggcaccagaacagcgagggcagaggccaggcugccgaccugaaauccacacaagcugccaucgaucagauuaaugggaagcucaaccgccugaucggaaaaaccaaugaaaaguuccaccagauugagaaggaauuuagcgagguggaaggccggauccaggaccuugagaaauacguggaggauacaaagaucgaccuguggucuuauaacgccgaacuccuggucgcucuggagaaccaacauaccauugaucucacggacuccgaaaugaauaaacuguucgagaagaccaaaaagcagcuuagagaaaacgcggaggauauggggaauggaugcuuuaagaucuaccacaaaugugacaacgccugcauuggcagcauccgcaaugggacauaugaucaugacguguaccgggacgaggcucugaacaauagauuccagauuaagggcguugaacucaaaucuggauacaaggauuggauccuguggaucuccuuugccauuagcugcuuccuucuguguguggcccuccugggcuuuaucaugugggcuugccagaaagggaacauucgcuguaauaucugcauuuga

SEQ ID NO: 192950 - RNA, 1701 nt, Artificial Sequence
  derived and/or modified sequence opt5 from hemagglutinin__InfluenzaA__AGG84179
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccgccucugagaucugcgacagcccgcaccauauccuugauggcgaaaauuguacacugauugacgcccuccugggggauccccagugcgacggauuucagaacaaaaagugggaucuguucgucgagagaucccgggcuuauucuaauuguuacccuuaugacgugcccgauuacgccagccuccgcucccugguugcuagcucuggcacccuugaauuuaacaaugaguccuucaacuggacgggggugacccaaaauggaacaagcucugccugcaucagacgguccaacaauagcuuuuucucucgccugaacuggcucacccaccugaauuuuaaauauccugcgcuuaacgucacaaugcccaacaaugagcaguucgacaagcuguacauuuggggcgugcaucacccuggcaccgauaaggaccagaucuuucucuaugcccaggcuuccgggagaauuacgguuagcacaaaacggucccaacaggccgugaucccgaacauuggaucucgccccagaguccggaauaucccuagccgcaucuccauuuacuggaccaucgugaagcccggcgauauucugcugaucaacagcacagggaaucucauugcuccuagaggauacuucaaaauccggucuggcaaguccagcaucaugcgcucugacgcccccauugggaaauguaacagcgaaugcaucaccccgaauggauccauuccuaacgacaagcccuuucagaaugugaacagaaucaccuauggcgcguguccucgguacgucaagcagucuacacugaaacuugccacgggcaugcgcaauguucccgagaagcaaaccagagggauuuucggagcuaucgccggcuuuaucgaaaacgggugggagggaaugauggauggcugguauggguuccggcaccagaauagcgagggaagaggccaggcugccgaccugaaauccacacaagccgcuauugaucagaucaacggcaagcucaaucgccugauugggaaaaccaacgaaaaguuccaucagaucgagaaagaauuuagcgagguggaaggacggauucaggaccuugagaaguacguggaggauacaaagaucgaccuguggucuuauaacgcggaacuccuggucgcccuggagaaucaacacaccauugaucucacggacuccgaaaugaacaaacuguucgagaagaccaaaaagcagcuuagagaaaaugcugaggauaugggcaacgggugcuuuaaaaucuaccauaagugugacaaugccugcaucggaagcauucgcaacggcacauaugaucacgacguguaccgggacgaggcccugaauaacagauuccagaucaaggggguugaacucaaaucuggcuacaaggauuggauucuguggaucuccuuugcuauuagcugcuuccuucuguguguggcccuccugggauuuaucaugugggcgugccagaaaggcaauauccgcuguaacauuugcaucuga

SEQ ID NO: 192951 - RNA, 1704 nt, Artificial Sequence
  derived and/or modified sequence opt5 from hemagglutinin__InfluenzaA__AGI02564
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaaacuuuaaugacuaugaggaacucaagcaucugcuuucucggaucaaccacuucgagaaaauucagaucauucccaagagcuccuggucuggccaugaagccagcuccggggugagcucugccuguccuuaccagggaacacccuccuuuuuccgcaauguuguguggcugaucaaaaagaacaauaccuauccuacaauuaaaagaagcuacaacaauaccaaccaagaggaucuccugauccuuuggggcauccaccacucuaacgacgcugccgagcagacgaagcuguaucagaauccgaccacauacauuuccgucggcaccagcacacucaaccagcggcuggugcccaagaucgcuacccgcucuaaagugaaugggcaauccggaagaauggauuucuucuggacgauucugaagccuaacgacgccaucaauuuugaaagcaacggcaauuucauugcgcccgaguacgccuauaaaaucgucaagaaaggggauuccgcuaucaugaagucugaaguugaguacggaaacugcaauacaaaaugucagaccccuauuggcgccaucaacagcuccaugcccuuucauaauauucacccgcucacaaucggggaaugcccuaaguaugugaaaagcaacaaacuggugcuugcuaccggacugcgcaauucuccccuccgggagagacggcgcaagagaggccuguucggcgccauugcgggguuuaucgagggaggcuggcaggggauggucgacggaugguacggcuaucaucacuccaacgaacaggggagcggauacgccgcugacaaagagucuacccaaaaggccaucgauggcgugacaaauaaaguuaacagcauuaucgacaagaugaacacgcaguucgaagcugugggccgggaguuuaauaaccuugaacgcagaauugagaaucugaacaagaaaauggaggauggguuccucgacgucuggaccuauaaugccgaacugcuggugcucauggagaacgaacggacacuggauuuccacgacuccaauguuaagaaccuuuacgauaaagugcgccugcagcucagaaauaacgccaaggagcugggaaauggcuguuuugaauuuuaccauaaaugcgacaacgaguguauggagucuguccggaaugggaccuaugauuacccucaauauagcgaagaggcuagacuuaagcgcgaagagaucuccggagugaagcuggagagcauuggcacauaccagauccucucuauuuauuccaccgucgcgagcucucuggcccuggcuaucaugguggccgggcucucccuguggaugugcagcaacggcucccuucagugccggaucuguauuuga

SEQ ID NO: 192952 - RNA, 1707 nt, Artificial Sequence
  derived and/or modified sequence opt5 from hemagglutinin__InfluenzaA__AGI02565
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuauccccgccaacgaucugugcuacccuggagacuuuaaugauuaugaggaacucaagcaucugcuuucucggauuaaccacuucgagaaaauccagauuauccccaagagcuccuggucuaaucaugaagccagccugggcguguccagcgcuuguccuuaccucgggaaacccuccuuuuuccgcaacguuguguggcugauuaagaaaaauucuaccuauccuacaaucaagagaagcuacaacaauaccaaccaggaggaccuucugguccucuggggaauccaccacccgaaugaugccgcugagcaaacaaagcuguaucagaaccccaccacguacauuucugugggcaccuccacacugaaccagcggcucgugccuaaaaucgccacccgcagcaaggucaauggccagucugggagaauggaauuuuucuggacaauucugaaacccaacgacgcgaucaauuuugaguccaacggaaauuucauugccccugaauacgcuuauaagaucguuaaaaagggcgauagcgccaucaugaaauccgagcuugaauacgggaacugcaauaccaagugucaaacgcccaugggagcuauuaacucuagcaugccguuucauaauauccacccucugacaauuggcgagugccccaaguaugugaaauccaaccggcucgugcuggccaccgggcuucgcaauagcccucagggagagagacggcgcaagaaaagaggccuguucggcgcgaucgccggguuuauugaaggaggcuggcaggggauggucgacggaugguacggcuaucaucacucuaacgagcagggguccggauacgcugccgacaaggaaagcacacaaaaagcuaucgauggcgugaccaauaagguuaacucuaucauugacaagaugaauacccaguucgaggccgugggccgggaauuuaacaaccucgagcgcagaaucgagaaucugaacaaaaagauggaagauggguuccuggacgucuggacauauaaugccgagcuccuggugcuuauggaaaacgagcggacgcuggauuuccacgacagcaauguuaaaaaccucuacgauaaggugcgccugcagcuuagagacaaugcuaaagaacugggaaacggcuguuuugaguucuaccauaagugcgauaaugaguguauggaauccguccggaacgggaccuaugacuacccccaauauucugaggaagcgagacucaagcgcgaggagauuagcggagugaaacuggaauccaucggcacauaccagauucugagcaucuauucuaccgucgccuccagccucgcucuggccauuaugguggccgggcuuucucuguggaugugcuccaauggcagccuccagugccggaucuguaucuga

SEQ ID NO: 192953 - RNA, 1704 nt, Artificial Sequence
  derived and/or modified sequence opt5 from hemagglutinin__InfluenzaA__AGI02566
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccgcugagcagauuaagcuguaucagaacccgaccacguacaucuccgucggcaccagcacacucaaucagcggcuggugcccaagauugccacccgcucuaaagugaacggccaauccgggagaauggacuuuuucuggacaauccugaagccuaaugaugcgauuaacuuugaaagcaauggaaacuucaucgcccccgaguacgcuuauaaaaucgucaaggaaggcgauuccgccauuaugaaaucugagguugaauacgggaauugcaacaccaagugucagacgccuaucggagcuauuaauagcuccaugcccuuucauaacauccacccgcucacaauuggcgagugcccuaaauaugugaaaagcaauaagcuggugcuugccaccgggcugcggaacucuccccuccgcgagagacggcgcaaaagaggacuguucggcgcgaucgccggcuuuaucgaagggggauggcagggcauggucgacgggugguacggauaucaucacuccaaugagcagggcagcggguacgcugccgacaaggaaucuacacaaaaagcuauugauggagugaccaacaagguuaacagcaucauugacaaaaugaauacccaguucgaggccgugggccgggaauuuaacaaucuugagcgcagaaucgagaaccugaauaagaagauggaagauggcuuccucgacgucuggacauauaacgccgagcugcuggugcucauggaaaaugagcggacgcuggauuuccacgacuccaacguuaaaaaucuuuacgauaaggugcgccugcagcucagagacaacgcuaaagaacuggggaauggauguuuugaguucuaccauaagugcgauaacgaguguauggaaucuguccggaauggcaccuaugacuacccucaauauagcgaggaagcgagacuuaaacgcgaggagauuuccggggugaagcuggaaagcaucggaacauaccagauucucucuaucuauuccaccgucgccagcucucuggcucuggccaucaugguggccggccucucccuguggaugugcagcaacgggucccuucagugccggauuuguaucuga

SEQ ID NO: 192954 - RNA, 1707 nt, Artificial Sequence
  derived and/or modified sequence opt5 from hemagglutinin__InfluenzaA__AGI02567
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaaggcuaaccccgccaaugaucucugcuacccuggaaacuuuaaugacuaugaggaacugaagcaucuucugucucggauuaaccacuucgagaaaauccagauuauccccaagagcuccuggucugaucaugaagccagcuccggcgugagcucugcuuguccuuaccaggggcgcuccagcuuuuucagaaauguuguguggcucauuaaaaagaacaaugccuaucccaccaucaaacggucuuacaacaauacaaaccaagaggaccugcuuguccuguggggcauucaccacccuaacgaugcugccgagcagacccgccucuaucagaauccgacaaccuacaucuccgugggaacgagcacccugaaccagagacuggugcccaagaucgcgacacggucuaaggucaauggccaauccgggcgcauggaauuuuucuggaccauucucaaaccuaacgacgccaucaauuuugagagcaacggaaauuucauugcucccgaauacgccuauaagaucguuaaaaagggcgauuccacaauuaugaaaucugagcuggaauacgggaacugcaauaccaagugucagacgccuaucggagcuaucaacagcuccaugcccuuucauaauauucacccgcuuacaaucggcgagugcccuaaauaugugaaaagcaacagacuggugcucgccaccgggcugcgcaauucuccccagggagagcggagacggaagaaacgcggccuuuucggcgcgauugccggguuuaucgaaggaggcuggcaggggauggucgacggaugguacggcuaucaucacuccaacgagcaagggagcggauacgcugccgacaaggaaucuacacagaaagcuauugauggcgugaccaauaagguuaacagcaucaucgacaaaaugaacacccaguucgaggccgugggcagagaauuuaauaaccuggagcggcgcauugagaaucucaacaagaagauggaagauggguuccuggacgucuggacauauaaugccgagcugcucgugcugauggaaaacgagagaacgcuugauuuccacgacuccaauguuaaaaaccuguacgauaaggugcggcuccaacugagagacaaugcuaaagaacuuggaaacggcuguuuugaguucuaccaucgcugcgauaaugaguguauggaaucuguccggaacgggaccuaugacuacccucaguauagcgaggaagcgagacugaagcgcgaggagaucuccggagugaaacucgaaagcauuggcacauaccagauccugucuauuuauuccaccgucgccagcucucuggcucucgccaucaugguggccgggcugucccuuuggaugugcagcaauggcucccugcagugccggauuuguaucuga

SEQ ID NO: 192955 - RNA, 1704 nt, Artificial Sequence
  derived and/or modified sequence opt5 from hemagglutinin__InfluenzaA__AGI02568
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagagaaccuccugauccuuuggggaauccaccacucuaaugacgccaccgagcagauuaagcuguaucagaacccgacgaccuacaucuccgucggcacaagcacccucaaucagcggcuggugcccaagauuggcacacgcucuaaagugaacgggcaauccggaagaauggacuuuuucuggaccauccugaagccuaaugaugcuauuaacuuugaaagcaauggcaacuucaucgcccccgaguacgcguauaaaaucgucaaggaaggggauuccgccauuaugaaaucugagguugaauacggaaauugcaacacgaagugucagacaccuaucggcgcuauuaauagcuccaugcccuuucauaacauccacccgcucaccauuggggagugcccuaaauaugugaaaagcaauaagcuggugcuugccacaggacugcggaacucuccccuccgcgagagacggcgcaaaagaggccuguucggcgcuaucgccggguuuaucgaaggaggcuggcaggggauggucgacggaugguacggcuaucaucacuccaaugagcaggggagcggauacgcggccgacaaggaaucuacccaaaaagcuauugauggcgugaccaacaagguuaacagcaucauugacaaaaugaauacacaguucgaggccgugggccgggaauuuaacaaucuugagcgcagaaucgagaaccugaauaagaagauggaagauggguuccucgacgucuggacguauaacgcugagcugcuggugcucauggaaaaugagcggacccuggauuuccacgacuccaacguuaaaaaucuuuacgauaaggugcgccugcagcucagagacaacgccaaagaacugggaaauggcuguuuugaguucuaccauaagugcgauaacgaguguauggaaucuguccggaaugggacauaugacuacccucaauauagcgaggaagccagacuuaaacgcgaggagauuuccggagugaagcuggaaagcaugggcaucuaccagauucucucuaucuauuccaccgucgcuagcucucuggcgcuggccaucaugguggcugggcucucccuguggaugugcagcaacggcucccuucagugccggauuuguaucuga

SEQ ID NO: 192956 - RNA, 1683 nt, Artificial Sequence
  derived and/or modified sequence opt5 from hemagglutinin__InfluenzaA__AGI60301
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggaucagcggacggaucgauuuccacuggcucaugcugaaccccaaugacaccgucaccuuuuccuucaacggcgccuuuauugcgccugaucgcgccucuuuccuuagagggaaaagcaugggaauccaguccggcguucagguggacgcuaacugcgaaggggauuguuaccauagcggaggcacaauuaucucuaaucugcccuuucagaacauugacucccgggccgugggcaagugcccucgcuaugucaagcaaagaagccuccugcuggcuacggggaugaaaaaugugcccgagaucccgaagggacggggccucuucggggccaucgccggauucauugaaaacggcugggaggggcugaucgauggcugguacggauuuagacaccagaaugcucagggcgaagggaccgcggccgacuacaaaucuacacaaagcgcuauugaccagaucaccggaaaacuuaaccgccugauugagaagacaaaucagcaguucgagcucaucgauaacgaauuuaaugagguugaaaagcaaaucggcaacgugauuaauuggacccgggacuccaucacggaggucuggucuuauaacgccgaacugcuuguggccauggagaaucagcacacaauugaucuggcugacagcgagauggauaaacucuacgaaagaguuaagcgccagcugcgggagaacgccgaagaggacgggaccggauguuucgaaaucuuucauaagugcgaugacgauuguauggcguccauuagaaauaacaccuaugaccacagcaaauaccgcgaggaggcuaugcagaaccggauccaaauugauccugugaagcugucuuccggcuauaaagacgucauccucugguucagcuuuggggccucuugcuucauccugcuugccauugugaugggccuggucuuuaucugcgugaagaauggaaacaugagauguacaauuugcaucuga

SEQ ID NO: 192957 - RNA, 1683 nt, Artificial Sequence
  derived and/or modified sequence opt5 from hemagglutinin__InfluenzaA__AGJ72861
augaacacccagauccugguguucgcccucauugcuaucauucccacaaaugccgacaagaucugccugggccaccaugcggucagcaacgggacgaaaguuaauacccuuacagagagaggaggcgaaguggugaacgcuaccgagacagucgaacggaccaauauuccucgcaucuguuccaaggggaaaaagacaguggaucugggacaaggcgggccgagaggaaccaucacggggcccccucagugcgaccaguuucucgaguucucugccgaucugauuauggaacggcgcgagggcagcgacguuuguuaccccggcaaauuugugaacgaggaagcccuuagacagauccugcgggaguccggaggcauugauaaggaagcuaugggguucaccuauucuggaauccgcacaaauggcgccaccagcgcuugcagacgguccgggucuagcuuuuacgccgagaugaaguggcuccuguccaacacagacaaugcggccuucccucaaaugaccaaaagcuauaagaacacgcgcaaaucucccgcucugauugucuggggaauccaccauuccgugagcacagccgagcagaccaagcucuacggcucuggcaauaaacugguuacagugggguccagcaacuaucagcagucuuuugucccuuccccgggagcuagaccccaagugaauggccagagcgggcggauugauuuccacuggcuuaugcugaacccuaaugacaccgugaccuuuuccuucaacggagccuuuaucgcgcccgaucgcgccucuuuccucagaggcaagagcauggggauccaguccggaguccagguugacgcuaacugugaaggcgauugcuaccauagcggcgggacaauuaucucuaaucugccuuuucaaaacauugacucccgggccgugggaaaguguccccgcuaugugaaacagagaagccuucugcucgcuacgggcaugaagaaugucccggagaucccuaaagggcggggacuguucggcgccauugccggguucaucgaaaacggcugggagggacugaucgauggcugguacggguuuagacaccagaaugcucaaggagaaggcaccgcggccgacuacaagucuacacagagcgcuauugaccagaucaccgggaaacucaaccgccugauugagaagacaaaucagcaauucgagcuuaucgauaacgaauuuaaugagguggaaaaacagauuggaaacguuaucaauuggacccgggacuccaucacggagguguggucuuauaacgccgaacugcucgucgccauggagaaucagcacacaauugaucuggcugacagcgagauggauaaacuuuacgaaagagugaagcgccagcugcgggagaacgccgaagaggacggcaccgggugcuucgaaaucuuucauaagugugaugacgauugcauggcguccauuagaaauaacaccuaugaccacagcaaguaccgcgaggaggcuaugcaaaaccggauccagauugaucccguuaaacucucuuccggcuauaaggacgugauccugugguucagcuuuggagccucuuguuucauucugcucgccaucgucaugggccugguguuuaucugcgucaaaaaugggaacaugagaugcacaauuuguaucuga

SEQ ID NO: 192958 - RNA, 1701 nt, Artificial Sequence
  derived and/or modified sequence opt5 from hemagglutinin__InfluenzaA__AGJ73327
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauucuuacccuaaacuguccaagagcuauauuaacgauaaggggaaagaagugcuuguccuguggggaauccaccaccccuccaccacagccgaccaucaaucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccauggaacgcaaugcugggagcggaauuaucauccccgacacaccugugcacgauugcaacaccaccugucagacacccaaaggcgccauuaauacgucucucccguuccaaaacauccauccuauuaccaucggcaagugccccaaguaugucaaauccacaaagcugagacuugcuaccgggcugcggaaugugccuagcauucagucucgcggacucuuuggcgccaucgccggguucaucgagggaggcuggacagggaugguugacggaugguacggcuaucaccaccagaacgaacagggcagcggguacgcugcggaccugaaauccacccaaaaugccauugauaagaucacgaacaaagugaauagcgucauugagaagaugaacacacaguuuaccgcugugggaaaggaguucaaucaucuugaaaagagaaucgagaaccugaauaagaaacucgacgauggcuuccuggacauuuggaccuacaacgccgaacugcucguucugcuugagaaugaacggacacuggauuaucacgacagcaacgugaagaaccucuacgagaaaguccgcaaucagcugaagaacaaugccaaggagaucgggaacggauguuuugaguucuaucauaaaugcgauaauaccuguauggaguccgugaagaacggcacauacgacuaucccaaauacagcgaagaggcuaaacuuaauagagagaaaaucgauggggucaagcuggaaucuacgcggauuuaucagauccucgccauuuacuccaccguggcgagcucucugguucugguggucucccucggcgagaucagcuuuuggaugugcuccaacggaucucugcaaugccgcauuuguaucuga

SEQ ID NO: 192959 - RNA, 1701 nt, Artificial Sequence
  derived and/or modified sequence opt5 from hemagglutinin__InfluenzaA__AGJ73329
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgaugcucccguccaugacugcaauaccaccugucaaacaccuaaaggcgccaucaacacgucucuccccuuccagaauauucacccgaucaccauugggaagugcccuaaguaugugaaauccacaaagcugagacuugcuaccggacugcggaacguucccagcauccagucucgcggccucuuuggggccauugccggauucaucgagggcggguggacaggaaugguggacggcugguacggcuaucaucaccagaaugaacaagggagcggauacgcugcggaucugaaauccacccagaacgccaucgacaagauuacgaauaaagucaacucugugaucgagaagaugaauacacaguuuaccgcuguuggcaaggaguucaaccaccuugagaaaagaauugagaaucugaacaagaaaguggaugacggguuccucgauaucuggaccuacaaugccgaacugcugguccuccuggagaacgaacggacacuugacuaucaugauagcaaugugaagaaccuguacgagaaaguccgcaaccagcucaagaauaacgccaaggagauuggaaauggcuguuuugaguucuaucacaaaugcgacaacaccuguauggaauccgugaagaaugggacauacgauuauccuaaauacagcgaagaggcuaagcugaacagagaagagaucgacggcguuaaacuugagucuacgcggaucuaucaaauucuggccaucuacuccaccguggcgagcucucucguccuggugguuucccugggagcuauuagcuuuuggaugugcuccaauggcucucuccagugccgcaucuguauuuga

SEQ ID NO: 192960 - RNA, 1701 nt, Artificial Sequence
  derived and/or modified sequence opt5 from hemagglutinin__InfluenzaA__AGJ73331
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaucccccuacauccgcggaucaacagucucucuaccagaacgccgacgcuuacguguucgugggcaccagcagauauuccaagaaauuuaagccggagauugccauccggcccaaaguccgcgggcaggagggaagaaugaauuacuauuggacgcugguugaaccuggcgauaagauuacauucgaggcuaccgggaaccugguggugccccgguacgccuuugcgauggaacgcaacgccggaagcggcaucauuaucucugacacaccuguccacgauugcaauaccaccugucaaacacccaaaggcgcuaucaacacgucccucccguuccagaauauucacccuaucaccauugggaagugccccaaguaugugaaaagcacaaagcugagacuugccaccggacugcggaacguuccuucuauccagagccgcggccucuuuggggcuauugccggauucaucgagggcggguggacaggaaugguggacggcugguacggcuaucaucaccagaaugaacaaggguccggauacgccgcugaccugaaaucuacccagaacgcgaucgaugagauuacgaauaaggucaacagcgugaucgagaaaaugaauacacaguuuaccgccguuggcaaggaguucaaccaccuugagaagagaauugaaaaucugaacaaaaagguggacgauggguuccucgacaucuggaccuacaaugcugagcugcugguccuccuggaaaacgagcggacacuugauuaucaugacuccaaagugaagaaucuguacgagaaaguccgcagccagcucaagaacaacgccaaggaaauuggaaauggcuguuuugaguucuaucacaaaugcgauaacaccuguauggaaucugugaagaaugggacauacgacuaucccaaauacuccgaggaagccaagcugaacagagaggagaucgauggcguuaaacuugaaagcacgcggaucuaucaaauucuggcuaucuacucuaccguggccuccagccucguccuggugguuucccugggagcgauuucuuuuuggaugugcagcaauggcucccuccagugccgcaucuguauuuga

SEQ ID NO: 192961 - RNA, 1701 nt, Artificial Sequence
  derived and/or modified sequence opt5 from hemagglutinin__InfluenzaA__AGJ73333
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacacauacguguucguggggaccagcagauauuccaagaaauuuaagccugagauugccauccggccgaaaguccgcgaucaggagggaagaaugaauuacuauuggacgcugguugaacccggcgacaagauuacauucgaggcuaccgggaaccugguggugccucgguacgccuuugcgauggaacgcaacgccggaagcggcaucauuaucucugauacacccguccaugacugcaauaccaccugucaaacaccuaaaggcgcuaucaacacgucccuccccuuccagaauauucacccgaucaccauugggaagugcccuaaguaugugaaaagcacaaagcugagacuugccaccggacugcggaacguucccucuauccagagccgcggccucuuuggggcuauugccggauucaucgagggcggguggacaggaaugguggacggcugguacggcuaucaucaccagaaugaacaaggguccggauacgccgcugaucugaaaucuacccagaacgcgaucgacaagauuacgaauaaagucaacagcgugaucgagaagaugaauacacaguuuaccgccguuggcaaggaguucaaccaccuugagaaaagaauugagaaucugaacaagaaaguggaugacggguuccucgauaucuggaccuacaaugcugaacugcugguccuccuggagaacgaacggacacuugacuaucaugauuccaaugugaagaaccuguacgagaaaguccgcaaccagcucaagaauaacgccaaggagauuggaaauggcuguuuugaguucuaucacaaaugcgacaacaccuguauggaaagcgugaagaaugggacauacgauuauccuaaauacucugaagaggccaagcugaacagagaagagaucgacggcguuaaacuugaguccacgcggaucuaucaaauucuggcuaucuacagcaccguggccucuucccucguccuggugguuagccugggagcgauuuccuuuuggaugugcucuaauggcagccuccagugccgcaucuguauuuga

SEQ ID NO: 192962 - RNA, 1701 nt, Artificial Sequence
  derived and/or modified sequence opt5 from hemagglutinin__InfluenzaA__AGJ73335
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggagcugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccacagccgaucaacagucucucuaccagaacgcugacaccuacguguucgugggcacgagcagauauuccaagaaauuuaagccugagauugccauccggccgaaaguccgcgaucaggaggggagaaugaauuacuauuggacacugguugaaccccgggacaagauuaccuucgaggcuacaggaaaccugguggugccucgcuacgccuuugcgauggaaagaaacgccggcagcgggaucauuaucucugauacccccguccaugacugcaauaccacaugucaaacgccuaaaggagcuaucaacaccucccuccccuuccagaauauucacccgaucacaauuggcaagugcccuaaguaugugaaaagcaccaagcugcggcuugccacaggccugcgcaacguucccucuauccagagcagagggcucuuuggagcuauugccggcuucaucgaagggggauggaccggcaugguggacgggugguacggauaucaucaccagaaugaacaaggcuccggcuacgccgcugaucugaaaucuacgcagaacgcgaucgacaagauuacaaauaaagucaacagcgugaucgagaagaugaauacccaguuuaccgccguugggaaggaguucaaccaccuugaaaaacggauugagaaucugaacaagaaaguggaugacggauuccucgauaucuggacauacaaugcugaacugcugguccuccuggagaacgaacgcacccuugacuaucaugauuccaaugugaagaaccuguacgagaaagucagaaaccagcucaagaauaacgccaaggagauuggcaauggguguuuugaguucuaucacaaaugcgacaacacauguauggaaagcgugaagaauggaacguacgauuauccuaaauacucugaagaggccaagcugaaccgggaagagaucgacggcguuaaacuugaguccacccgcaucuaucaaauucuggcuaucuacagcacaguggccucuucccucguccuggugguuagccugggggcgauuuccuuuuggaugugcucuaauggcagccuccagugcagaaucuguauuuga

SEQ ID NO: 192963 - RNA, 1701 nt, Artificial Sequence; identical to SEQ ID NO: 189478
  derived and/or modified sequence opt5 from hemagglutinin__InfluenzaA__AGJ73337

SEQ ID NO: 192964 - RNA, 1701 nt, Artificial Sequence; identical to SEQ ID NO: 189478
  derived and/or modified sequence opt5 from hemagglutinin__InfluenzaA__AGJ73339

SEQ ID NO: 192965 - RNA, 1701 nt, Artificial Sequence; identical to SEQ ID NO: 189478
  derived and/or modified sequence opt5 from hemagglutinin__InfluenzaA__AGJ73341

SEQ ID NO: 192966 - RNA, 1701 nt, Artificial Sequence
  derived and/or modified sequence opt5 from hemagglutinin__InfluenzaA__AGJ73343
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcagaaugggaaacuuuguaagcugagaggaguugcuccccuccaccugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcaacuuuccagcgucucuuccuucgaacgcuuugagaucuuccccaagaccagcucuuggccuaaccaugacuccaauaagggagugacagccgcuuguccccacgccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccagaaugcugaugccuacguguucgugggcacauccaaguauagcaaaaaguuuaaaccugagauugcugucagaccgaagguucgggaccaagaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccacgauugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaccaucaaaacgaacagggcucuggguacgcugcggaccuuaagagcacacagaaugccaucgauaaaaucaccaacaaggucaauuccgugauugagaagaugaacacgcaguuuacagcuguuggaaaagaguucaaucaccuggaaaagcgcaucgagaaccucaauaaaaagguggacgauggcuuccuggacauuuggaccuacaacgccgaacugcucguccugcuugagaaugaaagaacccuggauuaucacgacagcaacgugaaaaaccucuacgagaagguccggucucaacugaagaauaacgccaaagagaucgggaauggauguuuugaguucuaucauaagugcgauaacacauguauggaguccgugaaaaauggcaccuacgacuauccuaaguacagcgaagaggcuaaacuuaaccgcgaagagauugaugggguuaagcuggagucuacaagaaucuaucagauccucgccauuuacuccacgguggcgagcucccugguccuggugguuucucucggcgcuaucagcuuuuggaugugcuccaauggaucucugcagugccggauuuguaucuga

SEQ ID NO: 192967 - RNA, 1701 nt, Artificial Sequence
  derived and/or modified sequence opt5 from hemagglutinin__InfluenzaA__AGJ73345
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugaggaugcuuacguguucgugggcacauccaaguauagcaaaaaguuuaaaccugagauugccgucagaccgaagguucgggaccaggaagggcgcaugaacuacuauuggacccugguggagcccggaaacaaaaucacguucgaagcuacaggcaaucugcucgugccuagauacgccuuugcgauggagcggaacgccgggucuggaauuaucauuuccgauacccccguccaugacugcaauacaaccugucaaaccccuaagggcgcuaucaacacaagccugcccuuccagaauauccacccgauuacgaucggcaagugcccuaaauaugugaagucuaccaaacuucgccuggccacagggcucagaaacguucccagcauucagucccggggacuguuuggcgcuaucgccggguucauugaaggaggcuggaccgggaugguggauggaugguacggcuaucaucaccagaaugagcaaggcucuggguacgccgcugaccuuaagagcacacagaacgcgaucgacaaaaucaccaauaaggucaacuccgugauugagaagaugaauacgcaguuuacagccguuggaaaagaguucaaccaccuggagaagcgcaucgaaaaucucaacaaaaagguggaugacggcuuccuggauauuuggaccuacaaugcugagcugcucguccugcuugaaaacgagagaacccuggacuaucaugauagcaacgugaaaaaucucuacgagaagguccggucucagcugaagaacaaugccaaagaaaucgggaacggauguuuugaguucuaucacaagugcgacaauacauguauggaauccgugaaaaacggcaccuacgauuauccuaaguacagcgaggaagccaaacuuaaucgcgaggagauugacgggguuaagcuggaaucuacaagaaucuaucaaauccucgcuauuuacuccacgguggccagcucccugguccuggugguuucucucggcgcgaucagcuuuuggaugugcuccaacggaucucugcagugccggauuuguaucuga

SEQ ID NO: 192968 - RNA, 1701 nt, Artificial Sequence; identical to SEQ ID NO: 190074
  derived and/or modified sequence opt5 from hemagglutinin__InfluenzaA__AGJ73347

SEQ ID NO: 192969 - RNA, 1701 nt, Artificial Sequence; identical to SEQ ID NO: 190074
  derived and/or modified sequence opt5 from hemagglutinin__InfluenzaA__AGJ73349

SEQ ID NO: 192970 - RNA, 1701 nt, Artificial Sequence
  derived and/or modified sequence opt5 from hemagglutinin__InfluenzaA__AGJ73351
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaaugcgcgaucaggagggaagaaugaauuacuauuggacacuggucgaacccggcgacaagauuaccuucgaggcuacagggaaccugguugugccucgguacgccuuugcgauggaacgcaacgccggauccggcaucauuaucagcgauacccccgugcaugacugcaauaccacaugucaaacgccuaaaggcgcuaucaacaccucucuccccuuccagaauauucacccgaucacaauugggaagugcccuaaguaugucaaauccaccaagcugagacuugccacaggacugcggaacgugcccagcauccagucucgcggccucuuuggggcuauugccggauucaucgagggcggguggaccggaaugguugacggcugguacggcuaucaucaccagaaugaacaagggagcggauacgccgcugaucugaaauccacgcagaacgcgaucgacaagauuacaaauaaagugaacucugucaucgagaagaugaauacccaguuuaccgccgugggcaaggaguucaaccaccuugagaaaagaauugagaaucugaacaagaaaguugaugacggguuccucgauaucuggacauacaaugcugaacugcuggugcuccuggagaacgaacggacccuugacuaucaugauagcaaugucaagaaccuguacgagaaagugcgcaaccagcucaagaauaacgccaaggagauuggaaauggcuguuuugaguucuaucacaaaugcgacaacacauguauggaauccgucaagaaugggacguacgauuauccuaaauacagcgaagaggccaagcugaacagagaagagaucgacggcgugaaacuugagucuacccggaucuaucaaauucuggcuaucuacuccacaguugccagcucucucgugcuggucgugucccugggagcgauuagcuuuuggaugugcuccaauggcucucuccagugccgcaucuguauuuga

SEQ ID NO: 192971 - RNA, 1701 nt, Artificial Sequence
  derived and/or modified sequence opt5 from hemagglutinin__InfluenzaA__AGJ73353
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccaaguauagcaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccaugauugcaacacaaccugucaaaccccuaagggcgccaucaauacaagccugcccuuccagucuauccacccgauuacgaucggcaagugcccuaaauauguuaagagcaccaaacuucgccuggcuacagggcucagaaacgugcccuccauucagucucggggacuguuuggcgccaucgccggguucauugagggaggcuggaccgggaugguggacggaugguacggcuaucaucaccagaaugaacaaggcagcggguacgcugcggaccuuaaguccacacagaacgccaucgauaaaaucaccaauaaggucaacagcgugauugagaagaugaauacgcaguuuacagcuguuggaaaagaguucaaccaccuggaaaagcgcaucgagaaucucaacaaaaagguggacgauggcuuccuggacauuuggaccuacaaugccgaacugcucguccugcuugagaacgaaagaacccuggauuaucaugacucuaaugugaaaaaccucuacgagaagguccggucccagcugaagaacaaugccaaagagaucgggaacggauguuuugaguucuaucacaagugcgauaauacauguauggagagcgugaaaaacggcaccuacgacuauccuaaguacucugaagaggcuaaacuuaaucgcgaagagauugaugggguuaagcuggaguccacaagaaucuaucaaauccucgccauuuacagcacgguggcguccucucugguccuggugguuagccucggcgcuaucuccuuuuggaugugcucuaacggaagccugcagugccggauuuguaucuga

SEQ ID NO: 192972 - RNA, 1701 nt, Artificial Sequence
  derived and/or modified sequence opt5 from hemagglutinin__InfluenzaA__AGJ73355
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacacauguauggaauccgugaagaaugggacguacgauuauccuaaauacagcgaagaggccaagcugaacagagaagagaucgacggcguuaaacuugagucuacccggaucuaucaaauucuggcuaucuacuccacaguggccagcucucucguccuggugguuucccugggagcgaccagcuuuuggaugugcuccaauggcucucuccagugccgcauuuguaucuga

SEQ ID NO: 192973 - RNA, 1701 nt, Artificial Sequence; identical to SEQ ID NO: 189891
  derived and/or modified sequence opt5 from hemagglutinin__InfluenzaA__AGJ73357

SEQ ID NO: 192974 - RNA, 1701 nt, Artificial Sequence
  derived and/or modified sequence opt5 from hemagglutinin__InfluenzaA__AGJ73361
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacauccucuagcugguccuacaucguggagaccucuagcuccgacaacggcacgugcuauccgggggauuuuauugacuacgaagaacugcgggagcagcuuagcucugucuccagcuucgaacgcuuugagaucuuccccaagaccucuuccuggccuaaucacgauagcaacaagggagugacagccgccuguccccaugcuggcgccaaaggcuuuuauaagaaucugaucuggcucguuaaaaaggggaacucuuacccuaaacuguccaagagcuauauuaaugacaagggaaaagaagugcuuguccuguggggcauccaccaccccuccaccacagcggaucaacagucucucuaccagaacgccgacaccuacguguucguggggacgagcagauauuccaagaaauuuaagccugagauugcuauccggccgaaaguccgcgaucaggagggaagaaugaauuacuauuggacacugguugaacccggcgacaagauuaccuucgaggccacagggaaccugguggugccucgguacgcuuuugccauggaacgcaacgcgggaagcggcaucuucauuucugauacccccguccaugacugcaauaccacaugucaaacgccuaaaggcgccaucaacaccucccuccccuuucagaauauccacccgauuacaaucgggaagugcccuaaguaugugaaaagcaccaagcugagacuugcuacaggacugcggaacguucccucuauucagagccgcggccucuucggggccaucgcuggauuuauugagggcggguggaccggaaugguggacggcugguacggcuaucaucaccagaaugaacaaggguccggauacgccgccgaucugaaaucuacgcagaacgcuaucgacaagaucacaaauaaagucaacagcgugauugagaagaugaauacccaguucaccgcgguuggcaaggaguucaaccaccuugagaaaagaaucgagaaucugaacaagaaaguggaugacggguuucucgauauuuggacauacaaugccgaacugcugguccuccuggagaacgaacggacccuugacuaucaugauuccaaugugaagaaccuguacgagaaaguccgcaaccagcucaagaauaacgcuaaggagaucggaaauggcuguuucgaauuuuaucacaaaugcgacaacacauguauggagagcgugaagaaugggacguacgauuauccuaaauacucugaagaggccaagcugaacagagaagagauugacggcguuaaacuugaguccacccggaucuaucaaauccuggccauuuacagcacaguggcuucuucccucguccuggugguuagccugggagccaucuccuucuggaugugcucuaauggcagccuccagugccgcauuuguaucuga

SEQ ID NO: 192975 - RNA, 1701 nt, Artificial Sequence; identical to SEQ ID NO: 190074
  derived and/or modified sequence opt5 from hemagglutinin__InfluenzaA__AGJ73363

SEQ ID NO: 192976 - RNA, 1701 nt, Artificial Sequence; identical to SEQ ID NO: 189891
  derived and/or modified sequence opt5 from hemagglutinin__InfluenzaA__AGJ73365

SEQ ID NO: 192977 - RNA, 1701 nt, Artificial Sequence
  derived and/or modified sequence opt5 from hemagglutinin__InfluenzaA__AGJ73367
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggccguacaucguggagaccagcuccucugacaacggcacgugcuaucccggggauuuuauuaauuacgaagaacugcgggagcagcuuagcuccgucagcucuuucgaacgcuuugagaucuucccuaagaccuccagcuggcccaaccacgacucuaauaagggaguggccgcugccuguccucaugcgggcgccaaauccuuuuauaagaaccugaucuggcucguuaaaaagggcaauagcuaccccaaacugucuaaguccuauauuaacgauaaggggaaagaagugcuuguccuguggggaauccaccacccuagcacauccgcugaccaacagucucucuaccagaaugccgaugcuuacguguucgugggcaccagcaaguauuccaaaaaguuuaaaccggagauugccgucagacccaagguucgggaccaggaggggcgcaugaacuacuauuggacacugguggaaccuggagauaaaaucaccuucgaggcgacgggcaaccugcucgugcccagauacgccuuugcuauggaacggaaugccgggagcggaauuaucauuucugacacaccuguccaagauugcaacaccacaugucagacccccaagggcgcuaucaauaccucccugccguuccagaacauccauccuauuacaaucggcaagugccccaaauauguuaagagcacgaaacuucgccuggccaccgggcucagaaaugugccuucuauucagagccggggacuguuuggcgccaucgcuggguucauugagggaggcuggacagggaugguggacggaugguacggcuaucaccaucaaaacgaacagggcuccggguacgcggccgaccuuaagucuacccagaaugcuaucgauaaaaucacaaacaaggucaauagcgugauugagaagaugaacacccaguuuacggccguuggaaaagaguucaaucaccuggaaaagcgcaucgagaaccucaauaaaaagguggacgauggcuuccuggacauuuggacauacaacgccgaacugcucguccugcuugagaaugaaagaacccuggauuaucacgacuccaacgugaaaaaccucuacgagaagguccggaaucaacugaagaacaaugcuaaagagaucgggaacggauguuuugaguucuaucauaagugcgauaauaccuguauggagagcgugaaaaacggcacauacgacuaucccaaguacucugaagaggccaaacuuaaucgcgaagagauugaugggguuaagcuggaguccaccagaaucuaucagauccucgcgauuuacagcacaguggcuucuucccugguccuggugguuagccucggcgccaucuccuuuuggaugugcucuaacggaagccugcagugccggauuuguaucuga

SEQ ID NO: 192978 - RNA, 1701 nt, Artificial Sequence
  derived and/or modified sequence opt5 from hemagglutinin__InfluenzaA__AGJ73369
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucuccccuuccagaauauucacccgaucacaauugggaagugcccuaaguaugugaaauccaccaagcugagacuugccacaggacugcggaacguucccagcauccagucucgcggccucuuuggggcuauugccggauucaucgagggcggguggaccggaaugguggacggcugguacggcuaucaucaccagaaugaacaagggagcggauacgccgcugaucugaaauccacgcagaacgcgaucgacaagauuacaaauaaagucaacucugugaucgagaagaugaauacccaguuuaccgccguuggcaaggaguucaaccaccuugagaaaagaauugagaaucugaacaagaaaguggaugacggguuccucgauaucuggacauacaaugcugaacugcugguccuccuggagaacgaacggacccuugacuaucaugauagcaaugugaagaaccuguacgagaaaguccgcaaccagcucaagaauaacgccaaggagauuggaaauggcuguuuugaguucuaucacaaaugcgacaacacauguauggaauccgugaagaaugggacguacgauuauccuaaauacagcgccgaagcuaagcugaacagagaggaaaucgacggcguuaaacuugagucuacccggaucuaucaaauucuggccaucuacuccacaguggcgagcucucucguccuggugguuucccugggagcuauuagcuuuuggaugugcuccaauggcucucuccagugccgcaucuguauuuga

SEQ ID NO: 192979 - RNA, 1701 nt, Artificial Sequence; identical to SEQ ID NO: 189478
  derived and/or modified sequence opt5 from hemagglutinin__InfluenzaA__AGJ73371

SEQ ID NO: 192980 - RNA, 1701 nt, Artificial Sequence
  derived and/or modified sequence opt5 from hemagglutinin__InfluenzaA__AGJ73373
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccacagccgaucaacagucccucuaccagaacgcugacaccuacguguucguggggacgucuagauauagcaagaaauuuaagccugagauugccauccggccgaaaguccgcgaucaggagggaagaaugaauuacuauuggacacugguugaacccggcgacaagauuaccuucgaggcuacagggaaccugguggugccucgguacgccuuugcgauggaacgcaacgccggauccggcaucauuaucagcgauacccccguccaugacugcaauaccacaugucaaacgccuaaaggcgcuaucaacaccucucaccccuuccagaauauucauccgaucacaauugggaagugcccuaaguaugugaaauccaccaagcucagacuggccacaggacuucggaacguucccagcauccagucucgcggccuguuuggggcuauugccggauucaucgagggcggguggaccggaaugguggacggcugguacggcuaucaccaccagaaugaacaagggagcggauacgccgcugaucucaaauccacgcagaacgcgaucgacaagauuacaaauaaagucaacucugugaucgagaagaugaauacccaguuuaccgccguuggcaaggaguucaaccaucuggagaaaagaauugagaaucuuaacaagaaaguggaugacggguuccuggauaucuggacauacaaugcugaacuccugguccugcucgagaacgaacggacccuggacuaucacgauagcaaugugaagaaccuuuacgagaaaguccgcaaccagcugaagaauaacgccaaggagauuggaaauggcuguuuugaguucuaucauaaaugcgacaacacauguauggaauccgugaagaaugggacguacgauuauccuaaauacagcgaagaggccaagcucaacagagaagagaucgacggcguuaaacuggagucuacccggaucuaucaaauucuugcuaucuacuccacaguggccagcucucugguccucgugguuucccugggagcgauuagcuuuuggaugugcuccaauggcucucugcagugccgcaucuguauuuga

SEQ ID NO: 192981 - RNA, 1701 nt, Artificial Sequence
  derived and/or modified sequence opt5 from hemagglutinin__InfluenzaA__AGJ73375
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccgaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccacagccgaccaacagucucucuaccagaaugcugaugccuacguguucgugggcaccagcagauauuccaaaaaguuuaaaccugagauugcuauccggccgaagguccgcgaccaggaagggagaaugaacuacuauuggacgcugauugagcccggagauaaaaucacauucgaagccaccggcaaccugguugugccucgguacgcguuugccauggagcgcaaugcugggagcggaauuaucaucucugacacacccgugcaugauugcaacaccaccugucaaacaccugaaggcgccauuaauacgucccuccccuuccagaacauccacccgauuaccaucggcaagugcccuaaauaugucaagagcacaaagcugagacuugcuaccgggcugcggaaugugcccucuauucagagccgcggacucuuuggcgccaucgccggguucaucgagggaggcuggacagggaugguugacggaugguacggcuaucaucaccagaacgagcaaggcuccggguacgcugcggaccugaaaucuacccagaaugccauugauaagaucacgaacaaagugaauagcgucauugaaaagaugaacacacaguuuaccgcugugggaaaagaguucaaucaccuugaaaagagaaucgagaaccugaauaagaaaguugacgauggcuuccucgacauuuggaccuacaacgccgaacugcuggugcuccuggagaaugagcggacacuugauuaucaugacuccaacgucaagaaccuguacgaaaaagugcgcaaucagcucaagaacaaugccaaagagaucgggaacggauguuuugaguucuaucacaagugcgauaauaccuguauggagagcgucaagaacggcacauacgacuauccuaaauacucugaagaggcuaagcugaauagagaggaaaucgauggggugaaacuugaguccacgcggauuuaucaaauccuggccauuuacagcaccguugcgucuucccucgugcuggucgugagccugggcgcuaucuccuuuuggaugugcucuaacggaagccuccagugccgcauuuguaucuga

SEQ ID NO: 192982 - RNA, 1701 nt, Artificial Sequence
  derived and/or modified sequence opt5 from hemagglutinin__InfluenzaA__AGJ73377
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccagcugucccagagcuggcgccaaaucuuuuuauaagaaccugaucuggcucguuaaaaagggcaauuccuacccuaaacugagcaaguccuauauuaacgauaaggggaaagaagugcuuguccuguggggaauccaucaccccucuaccacagcggaccaacagagccucuaccagaaugccgaugcuuacguguucgugggcaccucccgguauagcaagaaauuuaagccugagauugccauccgcccgaaagucagagaccaggaggggcggaugaacuacuauuggacgcugguugaacccggagauaagauuacauucgaggcuaccggcaaccugcucgugccucgcuacgccuuugcgauggaaagaaaugccgggucuggaaucauuaucuccgacacacccgugcacgauugcaacaccaccugucaaacaccuaaaggcgcuaucaauacgagccugcccuuccagaacauucauccgaucaccauuggcaagugcccuaaguaugucaaaucuacaaaacuucggcuggccaccgggcuccgcaaugugcccagcauccaguccagaggacuguuuggcgcuauugccggguucaucgagggaggcuggacagggaugguugacggaugguacggcuaucaccaucagaacgaacaaggcucuggguacgccgcugaccuuaagagcacccagaaugcgaucgauaagauuacgaacaaagucaauuccgugaucgagaagaugaacacacaguuuaccgccgugggaaaggaguucaaucaccuggaaaaacggauugagaaccucaauaagaaaguugacgauggcuuccuggacaucuggaccuacaacgcugaacugcucgugcugcuugagaaugaacgcacacuggauuaucacgacagcaacgucaagaaccucuacgagaaagugagaaaucagcugaagaacaaugccaaggagauugggaacggauguuuugaguucaaucauaaaugcgauaacaccuguauggagucugucaagaauggcacauaugacuacccuaaauauuccgaagaggccaaacuuaacaaggaagagaucgauggggugaagcuggagagcacgcggaucuaccaaauucucgcuaucuauucuaccguugccuccagccuggugcuggucgugucccucggcgcgauuucuuuuuggaugugcagcaauggaucccugcagugccgcaucuguauuuga

SEQ ID NO: 192983 - RNA, 1701 nt, Artificial Sequence
  derived and/or modified sequence opt5 from hemagglutinin__InfluenzaA__AGJ73380
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaauccuuuuauaagaaccugaucuggcucguuaaaaagggcaauucuuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgggcaggagggaagaaugaacuacuauuggacgcugauugaacccggcgacaagaucacauucgaggccaccgggaaccugguugugccucgguacgcguuugccauggaacgcaaugcuggaagcggcauuaucaucucugauacacccgugcaugacugcaacuccaccugucaaaccccuaaaggcgccauuaauacaagccuccccuuccagaacauccacccgauuacgaucgggaagugcccuaaguaugucaaaucuaccaagcugagacuugcuacaggacugcggaaugugcccagcauucagucccgcggccucuuuggggccaucgccggauucaucgagggcggguggaccggaaugguugauggcugguacggcuaucaucaccagaacgaacaagggucuggauacgcugcggaccugaaaagcacacagaaugccauugacaagaucaccaacaaagugaauagcgucauugagaagaugaacacgcaguuuacagcugugggcaaggaguucaaucaccuugagaaaagaaucgagaaccugaauaagaaaguugaugacggguuccucgauauuuggaccuacaacgccgaacuguuugugcugcucgagaaugaacggacccuggacuaucaugauagcaacgucaaggaccuuuacgagaaagugcgcaaccagcugaagaauaacgccaaggagaucggaaauggcuguuucgaauuuuaucacaaaugcgauaacacauguauggagucugucaagaaugggaccuacgacuauccuaaauacuccgaagaggcuaagcucaacagagagaaaaucgauggcgugaagcuggaaagcacacggauuuaucaaauccuugccauuuacucuacgguugcguccagccuggugcucgucgugucccugggagcuaucucuuucuggaugugcagcaauggcucccugcagugccgcauuuguaucuga

SEQ ID NO: 192984 - RNA, 1701 nt, Artificial Sequence
  derived and/or modified sequence opt5 from hemagglutinin__InfluenzaA__AGK62991
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaagccuccggacgcauuacaguuagcaccaagagaucccagcaggcugugaucccgaauauuggcucucggccccgcaucagaaacaucccuagccggauuuccaucuacuggacaauugucaaacccggggauauccugcugauuaauagcaccggaaaccucaucgccccucgcggcuacuucaagaucagaucugggaaauccagcauuaugcggucugacgcucccaucggaaaguguaauagcgaaugcauuaccccgaacggcuccaucccuaaugacaagcccuuucagaacgugaaucgcauuacauauggcgccuguccuagauacgugaaacaaucuacgcugaaacuugcgaccgggaugcggaacguccccgagaagcagacacgcggaaucuucggcgccaucgcuggguuuauugaaaauggaugggagggcaugguugaugggugguauggauucagacaccagaacagcgagggccggggccaagccgcugaccugaaguccacccaggccgccaucgaucagauuaaugggaaacucaacagacugaucggaaagacaaaugaaaaauuccaccagauugagaaggaauuuagcgagguggaaggccgcauccaagaccuugagaaguacguggaggauaccaaaauugaccuguggucuuauaacgcugaacuccuggucgcgcuggagaaccagcauacgaucgaucucacagacuccgaaaugaauaagcuguucgagaaaaccaagaaacagcuucgggaaaacgccgaggauauggggaauggaugcuuuaagaucuaccacaagugugacaacgcuugcauuggcagcaucagaaaugggaccuauaaccaugauguguaccgcgacgaggcccugaauaaccgguuccagauuaaaggcguugaacucaagucuggauacaaagacuggauccuguggauuuccuuugccaucagcugcuuccuucuguguguggcucuccugggcuuuaucaugugggccugccaaaaggggaauauuagauguaacaucugcauuuga

SEQ ID NO: 192985 - RNA, 1701 nt, Artificial Sequence
  derived and/or modified sequence opt5 from hemagglutinin__InfluenzaA__AGK62993
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucucuaaguguaauagcgccugcauuaccacaaacggauccaucccgaaugacaagccuuuucagaacgucaaucgcauuacguacggcgcgugucccagauauguuaaacaaaacacccugaaacuugccacaggcaugcggaaugugccugaaaaacagacccgcgggaucuucggagcuauugccggcuuuaucgagaacgggugggaaggaaugguggacggcugguacggguucagacaccagaauagcgagggacggggccaagcugccgaucugaagucuacacaggccgcuaucgaccagauuaacggcaaacucaacagacugaucgggaagaccaaugagaaauuccaucagauugaaaaggaguuuuccgaagucgagggacgcauccaagaucuugaaaaguauguggaggacacgaaaauugaucuguggagcuacaacgcggagcuccugguugcccuggaaaaucagcacacaaucgaccucaccgauucugagaugaacaagcuguucgaaaagaccaagaaacagcuucgggagaaugcugaagacaugggcaacgggugcuuuaagauuuaucauaagugugauaaugccugcaucggauccaucagaaacggcacauacgaccacgauguguaucgcgacgaggcccugaauaaccgguuccagauuaaaggggucgagcucaagagcggcuacaaagacuggauccuguggauuucuuuugcuaucuccugcuuccuucuguguguggcccuccugggauuuauuauguggagcugccaaaagggcaauaucagauguaacaucugcauuuga

SEQ ID NO: 192986 - RNA, 1701 nt, Artificial Sequence
  derived and/or modified sequence opt5 from hemagglutinin__InfluenzaA__AGK62995
augaagaccaucauugcccugagcuacauccucugccugguguucgcucagaaacuucccggcaacgacaauuccacagccacgcugugucucgggcaccaugcgggaccuaacggcaccauugucaagacaaucaccaaugaucaaauugagguuacaaacgcuaccgaacuggugcagucuagcuccacaggggagaucugcgacucuccgcaccagauccuugauggagaaaauuguacccugauugacgcccuccugggcgauccccagugcgacggguuucaaaacaaaaagugggaucuguucguggagagaagcaaagccuauuccaauuguuacccuuaugacguccccgauuacgcuucucuccggagccugguggccuccagcggaacgcuugaauuuaacaaugagucuuucaacuggaccggcguuacacagaauggcaccuccagcgcuugcauccgcagaucuaacaauuccuuuuucagccggcugaacuggcucacacaucugaauuuuaaguauccugcccuuaacgugaccaugcccaacaaugagcaguucgacaagcuguacauuuggggaguccaccauccugggacggauaaagaccagaucuuucucuaugcgcaaucuuccggccgcauuacagugagcaccaagagaucccagcaggccguuaucccgaacauugggucucggccccgcaucagaaauaucccuagccggauuuccaucuacuggacaauugugaaacccggagauauccugcugauuaacagcaccggcaaucucaucgcuccucgcggguacuucaagaucagaucuggaaaauccagcauuaugcggucugacgcccccaucggcaaguguaacagcgaaugcauuaccccgaauggcuccaucccuaacgacaagcccuuucagaaugucaaccgcauuacauauggggcuuguccuagauacgugaaacaaucuacgcugaaacuugccaccggaaugcggaaugugcccgagaagcagacacgcggcaucuucggggcgaucgccggauuuauugaaaacggcugggaggggauggucgauggaugguauggcuucagacaccagaauagcgagggccgggggcaagcugccgaccugaaguccacccaggcugccaucgaucagauuaacggaaaacucaauagacugaucggcaagacaaacgaaaaauuccaccagauugagaaggaauuuagcgagguugaagggcgcauccaagaccuugagaaguacguggaggauaccaaaauugaccuguggucuuauaacgccgaacuccugguggcucuggagaaucagcauacgaucgaucucacagacuccgaaaugaacaagcuguucgagaaaaccaagaaacagcuucgggaaaaugcggaggauaugggaaacggcugcuuuaagaucuaccacaagugugacaaugccugcauugggagcaucagaaacggcaccuauaaucaugaugucuaccgcgacgaggcucugaacaaucgguuccagauuaaaggaguggaacucaagucuggcuacaaagacuggauccuguggauuuccuuugccaucagcugcuuccuucuguguguugcccuccugggguuuaucaugugggcuugccaaaagggaaacauuagauguaauaucugcauuuga

SEQ ID NO: 192987 - RNA, 1701 nt, Artificial Sequence
  derived and/or modified sequence opt5 from hemagglutinin__InfluenzaA__AGK62997
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgauaaguucgacaaacuguauauuuggggcgugcaucacccugggacggauaaggaccagaucuuucucuacgcgcaggccucuggacgcauuacaguuuccaccaaaagaagccaacaggcugugaucccgaauauuggcucccggccccgcgucagaaacaucccuucucgggugagcaucuauuggacaauugugaagcccggggauauccugcugauuaauuccaccggaaaccucaucgccccucgcggcuacuucaaaauuagaagcgggaagucuuccaucaugcggagcgacgcucccaucggaaaguguaauucugccugcauuaccccgaacggcagcaucccuaaugacaaacccuuucagaacgucaaucgcauuacauguggcgcgugcgccagauacguuaagcagaacacgcugaaacuugcuaccgggaugcggaaugugccugagaagcaaacacgcggaaucuucggcgccauugcuguguuuaucgaaaacgggugggagggaauggucgauggcugguauggguucagacaccaaaauuccgaaggacgggagcaggccgccgcuuuccagucuacccaggcggccaucgaccagauuaucggcaaacugaacagacucauuggcgagacaaacgaaaaguuucaucagaucgagaaagaguucagcgaaguggaacgccggauucaagcucuggagaaguacguugaggauaccaagaucgaccuuugguccuauaaugccgaacugcucguggcccuggagaaccagcacacgauugaucugacagacagcgaaaugaauaaacucuuugagaagaccaaaaagcagcugagagaaaacgcugaggauauggggaauggauguuucaaaaucuaccauaagugcgacaacgccugcaucggcucuauucgcaaugggaccuaugaucacgacgucuaccgggaugaggcgcuuaacaauagauuucagaucaagggaguggaacugaaauccggcuauaaggacuggauucucuggaucagcuucgcuauuucuuguuuucugcuuugcguugcccugcucggguucaucaugugguccugucaaaaaggcaacauccgcugcaauauuuguaucuga

SEQ ID NO: 192988 - RNA, 1701 nt, Artificial Sequence
  derived and/or modified sequence opt5 from hemagglutinin__InfluenzaA__AGK62999
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaacuuuaaguauccugcccuuaacgucaccaugcccaauaacgagcaguucgauaagcuguacauuuggggcgugcaccauccugggacggacaaagaucagaucuuucucuaugcgcaagccucuggacgcauuacaguuuccaccaagagaagccagcaggcugugaucccgaauauuggcucccggccccgcgucagaaacaucccuucucgggugagcaucuacuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccccgaacggcagcaucccuaaugacaagcccuuucagaacgucaaucgcauuacauauggcgcguguccuagauacguuaaacaaaacacgcugaaacuugccaccgggaugcggaaugugcccgaaaaacagacacgcggaaucuucggcgcuauugccggguuuaucgagaacggaugggaaggcaugguggacgggugguauggauucagacaccaaaauuccgagggccggggccaggcugccgaucugaagucuacccaggccgcuaucgaccagauuaacgggaaacucaacagacugaucggaaagacaaaugagaaauuccaccagauugaaaaggaguuuagcgaagucgagggccgcauccaagaucuugaaaaguacguggaggacaccaaaauugaucugugguccuauaacgcggagcuccugguugcccuggaaaaucagcauacgaucgaccucacagauagcgagaugaacaagcuguucgaaaagaccaagaaacagcuucgggagaaugcugaagacauggggaacggaugcuuuaagauuuaccacaagugugauaaugccugcaucggcucuaucagaaacgggaccuaugaccaugauguguaccgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 192989 - RNA, 1701 nt, Artificial Sequence
  derived and/or modified sequence opt5 from hemagglutinin__InfluenzaA__AGK63001
augaagaccaucauugcccugagcuacauccucugccugguguucgcucagaaacuucccggcaacgacaauuccacagccacgcugugucucguccaccaugcgguuccuaacgggaccauugugaagacaaucaccaaugaucaaauugaggugacaaacgcuaccgaacugguccagucuagcuccacaggagagaucugcgacucuccgcaccagauccuugauggcgaaaauuguacccugauugacgcccuccugggggauccccagugcgacggauuucaaaacaaagagugggaucuguucguggaaagaagcaaggccuauuccaauuguuacccuuaugacguucccgauuacgcuucucuccggagccugguggccuccagcggcacgcuugaguuuaacaaugagucuuucaacuggaccggggucacacagaauggaaccuccagcgcuugcauccgcagaucuaacuccagcuuuuucucucggcugaauggccucacacaucugaacuuuaaauauccugcccuuaaugugaccaugcccaacaacgaacaguucgacaagcuguacauuuggggcguucaccauccugggacggauaaggaccagaucuuucucuaugcgcaauccagcggacgcauuacaguguccaccaaaagaucucagcaggccgucaucccgaauauuggcagccggccccgcaucagaaacaucccuucccggauuagcaucuacuggacaauugugaagcccggggauauccugcugauuaauucuaccggaaaccucaucgcuccucgcggcuacuucaaaaucagauccggaaagagcucuauuaugcggagcgacgcccccaucgggaaauguaauuccgagugcauuaccccgaacggcucuaucccuaaugacaagcccuuucagaacgugaaucgcauuacauauggcgcuuguccuagauacgucaagcaaagcacgcugaaacuugccaccgggaugcggaacguucccgaaaagcagacacgcggaaucuucggcgcgaucgccggguuuauugagaauggaugggagggcaugguggaugggugguauggauucagacaccagaacuccgaaggccgggagcaagcugccgacuuccagagcacccaggcugccaucgaucagauuaucggcaaacugaauagacucauugggaagacaaacgaaaaauuucaccaaaucgagaaggaguucucugaaguggagcgccggauucaggaccuggaaaaauacgucgaggauaccaagaucgaccuuugguccuauaaugccgaacugcucguggcucuggagaaccagcauacgaucgaucugacagacagcgaaaugaacaagcucuuugagaaaaccaagaaacagcugagagagaaugcggaagauaugggaaacggcugcuucaagauuuaccacaaaugugacaaugccugcaucgggucuauucgcaacggaaccuauaaucaugauguuuaccgggacgaggcucuuaacaauagauuucaaaucaagggcguggaacugaaguccggguacaaagacuggauucucuggaucagcuucgccaucuccugcuuucugcuuugugucgcccugcucggcuucauuauguggucuugccagaagggaaacauccgcuguaauauuugcaucuga

SEQ ID NO: 192990 - RNA, 1701 nt, Artificial Sequence
  derived and/or modified sequence opt5 from hemagglutinin__InfluenzaA__AGK63003
augaagaccaucauugcccugagcuacauccucugccugguguucgcucagaaacuucccggcaacgacaauuccacagccacgcugugucucgggcaccaugcgggaccuaacggcaccauugucaagacaaucaccaaugaucaaauugagguuacaaacgcuaccgaacuggugcagucuagcuccacaggggagaucugcgacucuccgcaccagauccuugauggagaaaauuguacccugauugacgcccuccugggcgauccccagugcgacggguuucaaaacaaaaagugggaucuguucaucgagagaagcaaagccuauuccaauuguuacccuuaugacgugcccgauuacgcuucucuccggagccuggucgccuccagcggaacgcuugaauuuaacaaugagucuuucaacuggaccggcgugacacagaauggcaccuccagcgcuugcauucgcagaucuaacuccagcuuuuucucucggcugaauuggcucacacaucugaacuuuaaguauccugcccuuaauguuaccaugcccaacaacgagcaguucgacaagcuguacaucuggggagugcaccauccugggacggauaaagaccagauuuuucucuaugcgcaauccagcggccgcaucacagucuccaccaagagaucucagcaggccgugauuccgaauaucgggagccggccccgcaucagaaacauuccuucccggaucagcauuuacuggacaaucguuaaacccggagauauucugcugaucaauucuaccggcaaccucaucgcuccucgcggguacuucaagauuagauccggaaaaagcucuaucaugcggagcgacgcccccauuggcaaguguaauuccgcuugcaucaccccgaacggcucuauuccuaaugacaagcccuuucagaacgugaaucgcaucacauauggggccuguccuagauacgucaaacaaagcacgcugaaacuugcgaccggaaugcggaacgugcccgaaaaacagacacgcggcaucuucggggccauugcuggauuuaucgagaauggcugggaagggaugguggauggaugguauggcuucagacaccagaacuccgagggccgggggcaagccgcugaccucaagagcacccaggccgccauugaucagaucaauggaaaacugaacagacugauuggcaagacaaaugagaaauuccaccagaucgaaaaggaguuuucugaagucgaggggcgcauucaagaccuugaaaaguacguugaggauaccaaaaucgaccugugguccuauaacgcugagcuccugguggcgcuggaaaaccagcauacgaucgaucucacagacagcgagaugaauaagcuguucgaaaagaccaagaaacagcuucgggagaacgccgaagauaugggaaauggcugcuuuaagauuuaccacaagugugacaacgcuugcaucgggucuauuagaaauggcaccuauaaccaugauguguaccgcgacgaggcccugaauaaccgguuccagaucaaaggagucgagcucaaguccggcuacaaagacuggauucuguggaucagcuuugccaucuccugcuuccuucuguguguggcucuccugggguuuauuaugugggccugccaaaagggaaauaucagauguaacauuugcaucuga

SEQ ID NO: 192991 - RNA, 1701 nt, Artificial Sequence
  derived and/or modified sequence opt5 from hemagglutinin__InfluenzaA__AGK63005
augaagaccaucauugcccugagcuacauccucugccugguguucgcucagaaacuucccggcaacgacaauuccacagccacgcugugucucguccaccaugcgguuccuaacgggaccauugugaagacaaucaccaaugaucaaauugaggugacaaacgcuaccgaacugguccagucuagcuccacaggagagaucugcgacucuccgcaccagauccuugauggcgaaaauuguacccugauugacgcccuccugggggauccccagugcgacggauuucaaaacaaaaagugggaucuguucguggagagaagcaaagccuauuccaauuguuacccuuaugacguucccgauuacgcuucucuccggagccugguggccuccagcggcacgcuugaauuuaacaaugagucuuucaacuggaccggggucacacagaauggaaccuccagcgcuugcauccgcagaucuaacuccagcuuuuucucucggcugaauggccucacacaucugaacuuuaaguauccugcccuugacgugaccaugcccaauaacgauaaguucgacaaacuguacauuuggggcguucaccauccugggacggauaaggaccagaucuuucucuaugcgcaguccagcggacgcauuacaguguccaccaaaagaucucaacaggccgucaucccgaacauuggcagccggccccgcaucagaaauaucccuucccggauuagcaucuacuggacaauugugaagcccggggacauccugcugauuaacucuaccggaaaucucaucgcuccucgcggcuacuucaaaaucagauccgggaaguccucuauuaugcggagcgaugcccccaucggaaaguguaacuccgagugcauuaccccgaauggcucuaucccuaacgacaaacccuuucagaaugugaaccgcauuacauauggcgcuuguccuagauacgucaagcagagcacgcugaaacuugccaccgggaugcggaauguucccgaaaagcaaacacgcggaaucuucggcgcgaucgccguguuuauugagaacgggugggaaggaaugguggauggcugguauggguucagacaccagaauagcgagggacgggagcaggcugccgacuuccaaagcacccaggcugccaucgaucagauuaacggcaaacugaauagacucaucggcaagacaaacgaaaaauuucaccagauugagaaggaguucucugaagucgaagggcgcauccaagaccuggagaaguacguggaggauaccaaaauugaccuuugguccuauaaugccgaacugcucguugcucuggagaaccagcauacgaucgaucugacagacagcgaaaugaacaagcucuuugagaaaaccaagaaacagcugcgggaaaaugcggaggauaugggaaacggcugcuucaagaucuaccacaagugugacaaugccugcauugggucuaucagaaacggaaccuauaaucaugacguguaccgcgaugaggcucuuaacaaucgguuucagauuaaaggcgucgaacugaaguccggguacaaagacuggauccucuggauuagcuucgccaucuccugcuuucugcuuuguguggcccugcucggcuucaucaugugggcuugccaaaagggaaacauuagauguaauaucugcauuuga

SEQ ID NO: 192992 - RNA, 1701 nt, Artificial Sequence
  derived and/or modified sequence opt5 from hemagglutinin__InfluenzaA__AGK63007
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaauuuuaaguacccugcccuuaacgucaccaugcccaacaaugagcaguucgacaagcuguauauuuggggcgugcaucacccugggacggauaaagaccagaucuuucucuacgcgcaagccucuggacgcauuacaguuuccaccaagagaagccagcaggcugugaucccgaacauuggcucccggccccgcgucagaaauaucccuucucgggugagcaucuauuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugaaugcauuaccccgaauggcagcaucccuaacgacaagcccuuucagaaugucaaccgcauuacauacggcgccuguccuagauauguuaaacaaaauacgcugaaacuugcgaccgggaugcggaacgugcccgagaagcagacacgcggaaucuucggcgccauugcuggguuuaucgaaaauggaugggagggcaugguggaugggugguacggauucagacaccagaacuccgagggccggggccaagccgcugaccugaagucuacccaggccgccaucgaucagauuaaugggaaacucaacagacugaucggaaagacaaacgaaaaauuccaucagauugagaaggaauuuagcgaggucgaaggccgcauccaagaccuugagaaguauguggaggauaccaaaauugaccugugguccuacaaugcugaacuccugguugcgcuggagaaccagcacacgaucgaucucacagacagcgaaaugaauaagcuguucgagaaaaccaagaaacagcuucgggaaaacgccgaggauauggggaauggaugcuuuaagauuuaucauaagugugacaacgcuugcaucggcucuaucagaaaugggaccuacgaucacgacguguaucgcgacgaggcccugaacaaucgguuccagauuaaaggcgucgaacucaaguccggauacaaagauuggauccuguggauuagcuuugccaucucuugcuuccuucuguguguggcucuccugggcuuuauuaugugggccugccaaaaggggaacaucagauguaauaucugcauuuga

SEQ ID NO: 192993 - RNA, 1701 nt, Artificial Sequence
  derived and/or modified sequence opt5 from hemagglutinin__InfluenzaA__AGK63009
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggccugcaaaauaaaaagugggaccucuuugucgagagaagcaaagcccauuccaacuguuauccuuacgaugugcccgacuaugcuucucugcggagccuuguugccuccagcgggacgcuggaguucaauaacgaaucuuuuaauuggaccggagugacacagaacggcaccuccagcgcuugcauccgcagaucuaauaacuccuucuuuagccggcucaauuggcugacacaccuuaacuucaaguacccugcccugaacgucaccaugcccaauaacgagcaguuugauaagcucuauauuuggggcgugcaucacccugggacggacaaagaucagaucuuccuguacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcucauuaauuccaccggaaaccugaucgccccucgcggcuacuuuaagauuagaagcgggaaaucuuccaucaugcggagcgaugcucccaucggaaaguguaauucugccugcauuaccccgaacggcagcaucccuaaugacaagcccuuccagaacgucaaucgcauuacauacggcgcguguccuagauauguuaaacaaaacacgcuuaagcuggccaccgggaugcggaaugugcccgaaaaacagacacgcggaaucuuuggcgcuauugccggguucaucgagaacggaugggaaggcaugguggacgggugguacggauuuagacaccaaaauuccgagggccggggccaggcugccgaucucaagucuacccaggccgcuaucgaccagauuaacgggaaacugaacagacuuaucggaaagacaaaugagaaauuccaucagauugaaaaggaguucagcgaagucgagggccgcauccaagaucuggaaaaguauguggaggacaccaaaauugaucucugguccuacaacgcggagcugcugguugcccucgaaaaucagcacacgaucgaccugacagauagcgagaugaacaaacuuuuugaaaagaccaagaaacagcugcgggagaaugcugaagacauggggaacggaugcuucaagauuuaucauaagugugauaaugccugcaucggcucuaucagaaacgggaccuacgaccacgauguguaucgcgacgaggcccucaauaaccgguuucagauuaaaggcgucgagcugaaguccggauacaaagacuggauccuuuggauuagcuucgcuaucucuugcuuucugcucuguguggcccugcugggcuucauuaugugggcgugccaaaaggggaauaucagauguaacaucugcauuuga

SEQ ID NO: 192994 - RNA, 1701 nt, Artificial Sequence
  derived and/or modified sequence opt5 from hemagglutinin__InfluenzaA__AGK63011
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaauccacgcugaagcuggcgaccgggaugcggaauguucccgagaaacagacacgcggaauuuucggcgccaucgcuggguuuaucgaaaacggaugggagggcaugguggaugggugguauggauucagacaccaaaauucugagggccggggccaggccgcugaccuuaagagcacccaggccgccauugaucagaucaacgggaaacucaauagacugauuggaaagacaaacgaaaaauuccaccagaucgagaaggaauuuuccgagguggaaggccgcauucaagaccuugagaaguacgucgaggauaccaaaaucgaccuguggagcuauaacgcugaacuccugguggcgcuggagaaucagcauacgauugaucucacagacucugaaaugaacaagcuguucgagaaaaccaagaaacagcuucgggaaaaugccgaggauauggggaacggaugcuuuaagaucuaccacaagugugacaaugcuugcaucggcuccauuagaaacgggaccuaugaucaugacguuuaccgcgacgaggcccugaauaaccgguuccagaucaaaggcguggaacucaagagcggauacaaagauuggauucuguggaucucuuuugccauuuccugcuuccuucugugugucgcucuccugggcuuuaucaugugggccugccaaaaggggaauaucagauguaacauuugcaucuga

SEQ ID NO: 192995 - RNA, 1701 nt, Artificial Sequence
  derived and/or modified sequence opt5 from hemagglutinin__InfluenzaA__AGK63013
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuugaugucaccaugcccaacaaugagcaguucgacaagcuguauauuuggggcgugcaucacccugggacggauaaagaccagaucuuucucuacgcgcaagccucuggacgcauuacaguuuccaccaagagaagccagcaggcugugaucccgaacauuggcucccggccccgcgucagaaauaucccuucucgggugagcaucuauuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugccugcauuaccccgaauggcagcaucccuaacgacaagcccuuucagaaugucaaccgcauuacauacggcgcgugugccagauauguuaaacaaaauacgcugaaacuugcuaccgggaugcggaacgugccugaaaagcagacacgcggaaucuucggcgccauugcuguguuuaucgagaaugggugggaaggaauggucgauggcugguacggguucagacaccagaacuccgagggacggggccaagccgccgcucugcagucuacccaggcggccaucgaccagauuacaggcaagcucaauagacugaucggggagaccaacgaaaaauuccaucaaauugagaaggaauuuagcgagguggaaggacgcauccaggcucuugagaaauauguugaggauacgaagauugaccugugguccuacaacgccgaacuccugguggcccuggagaaucagcacacaaucgaucucaccgacagcgaaaugaacaagcuguucgagaaaaccaagaaacagcuucgggaaaaugcugaggauaugggcaacgggugcuuuaagauuuaucauaaaugugacaaugccugcaucggaucuaucagaaacggcacauacgaucacgacgucuaucgcgaugaggcgcugaauaaccgguuccaaauuaaggggguggaacucaaguccggcuacaaagacuggauccuguggauuagcuuugcuaucucuugcuuccuucuguguguugcccuccugggauuuauuaugugguccugccagaagggcaauaucagauguaacaucugcauuuga

SEQ ID NO: 192996 - RNA, 1701 nt, Artificial Sequence
  derived and/or modified sequence opt5 from hemagglutinin__InfluenzaA__AGK63015
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcaagucuaacuccagcuuuuucucuagacugaauuggcucacacaucugaacuuuaaguauccugcccuuaaugucaccaugcccaacaacgagcaguucgacaaacuguacauuuggggcgugcaccauccugggacggauaaggaccagaucuuucucuaugcgcaauccagcggacggauuacaguuuccaccaaacgcucucagcaggccgugaucccgaauauuggcagcagaccccggauccgcaacaucccuuccagaauuagcaucuacuggacaauugucaagcccggggauauccugcugauuaauucuaccggaaaccucaucgcuccucggggcuacuucaaaauccgcuccggaaagagcucuauuaugagaagcgacgcccccaucgggaaguguaauuccgaaugcauuaccccgaacggcucuaucccuaaugacaaacccuuucagaacgugaaucggauuacauauggcgcuuguccucgcuacgugaagcaaagcacgcugaaacuugccaccgggaugagaaacguccccgagaagcagacacggggaaucuucggcgcgaucgccggguuuauugaaaauggaugggagggcaugguugaugggugguauggauuccgccaccagaacuccgagggcagaggccaagcugccgaccugaaaagcacccaggcugccaucgaucagauuaaugggaagcucaaccggcugaucggaaaaacaaaugaaaaguuccaccagauugagaaggaauuuucugagguggaaggcagaauccaagaccuugagaaauacguggaggauaccaagauugaccugugguccuauaacgccgaacuccuggucgcucuggagaaccagcauacgaucgaucucacagacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggaccuauaaccaugauguguacagagacgaggcucugaauaaccgcuuccagauuaagggcguugaacucaaauccggauacaaggacuggauccuguggauuagcuuugccaucuccugcuuccuucuguguguggcccuccugggcuuuaucaugugggcuugccaaaaagggaauauucgguguaacaucugcauuuga

SEQ ID NO: 192997 - RNA, 1701 nt, Artificial Sequence; identical to SEQ ID NO: 190006
  derived and/or modified sequence opt5 from hemagglutinin__InfluenzaA__AGK63017

SEQ ID NO: 192998 - RNA, 1701 nt, Artificial Sequence
  derived and/or modified sequence opt5 from hemagglutinin__InfluenzaA__AGK63019
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacuccagcuuuuucucucggcugaauuggcucacacaucugaacuuuaaguauccugcccuuaaugucaccaugcccaacaacgagcaguucgacaagcuguacauuuggggcgugcaccauccugggacggauaaagaccagaucuuucucuaugcgcaauccagcggacgcauuacaguuuccaccaagagaucucagcaggccgugaucccgaauauuggcagccggccccgcaucagaaacaucccuucccggauuagcaucuacuggacaauugucaaacccggggauauccugcugauuaauucuaccggaaaccucaucgcuccucgcggcuacuucaagaucagauccgggaaaagcucuauuaugcggagcgacgcccccaucggaaaguguaauuccgaaugcauuaccccgaacggcucuaucccuaaugacaagcccuuucagaacgugaaucgcauuacauauggcgcuuguccuagauacgugaaacaaagcacgcugaagcuggccaccgggaugcggaacguccccgagaaacagacacgcggaaucuucggcgcgaucgccggguuuauugaaaauggaugggagggcaugguugaugggugguauggauucagacaccagaacuccgagggccggggccaagcugccgaccuuaagagcacccaggcugccaucgaucagauuaaugggaaacucaacagacugaucggaaagacaaaugaaaaauuccaccagauugagaaggaauuuucugagguggaaggccgcauccaagaccuugagaaguacguggaggauaccaaaauugaccugugguccuauaacgccgaacuccuggucgcucuggagaaccagcauacgaucgaucucacagacagcgaaaugaauaagcuguucgagaaaaccaagaaacagcuucgggaaaacgcggaggauauggggaauggaugcuuuaagaucuaccacaagugugacaacgccugcauuggcucuaucagaaaugggaccuaugaucaugacguguaccgcgacgaggcucugaacaaucgguuccagauuaaaggcguugaacucaaguccggauacaaagauuggauccuguggauuagcuuugccaucuccugcuuccuucuguguguggcccuccugggcuuuaucaugugggcuugccaaaaggggaacauuagauguaauaucugcauuuga

SEQ ID NO: 192999 - RNA, 1701 nt, Artificial Sequence; identical to SEQ ID NO: 192873
  derived and/or modified sequence opt5 from hemagglutinin__InfluenzaA__AGK63021

SEQ ID NO: 193000 - RNA, 1701 nt, Artificial Sequence
  derived and/or modified sequence opt5 from hemagglutinin__InfluenzaA__AGK63025
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucaucgagagaagcaaagccuauuccaauuguuacccuuaugacguccccgauuacgcuucucuccggagccugguggccuccagcgggacgcuugaauuuaacaaugagucuuucaacuggaccggaguuacacagaauggcaccuccagcgcuugcauucgcaagucuaacuccagcuuuuucucuagacugaauuggcucacacaucugaacuuuaaguauccugcccuuaaugugaccaugcccaacaacgagcaguucgacaaacuguacaucuggggcguccaccauccugggacggauaaggaccagauuuuucucuaugcgcaauccagcggacggaucacaguguccaccaaacgcucucagcaggccguuauuccgaauaucggcagcagaccccggauccgcaacauuccuuccagaaucagcauuuacuggacaaucgugaagcccggggauauucugcugaucaauucuaccggaaaccucaucgcuccucggggcuacuucaaaauucgcuccggaaagagcucuaucaugagaagcgacgcccccauugggaaguguaauuccgaaugcaucaccccgaacggcucuauuccuaaugacaaacccuuucagaacgucaaucggaucacauauggcgcuuguccucgcuacgugaagcaaagcacgcugaaacuugccaccgggaugagaaacgugcccgagaagcagacacggggaaucuucggcgcgauugccggguuuaucgaaaauggaugggagggcauggucgaugggugguauggauuccgccaccagaacuccgagggcagaggccaagcugccgaccugaaaagcacccaggcugccauugaucagaucaaugggaagcucaaccggcugauuggaaaaacaaaugaaaaguuccaccagaucgagaaggaauuuucugagguugaaggccgcauucaagaccuugagaaauacguggaggauaccaagaucgaccugugguccuauaacgccgaacuccugguggcucuggagaaccagcauacgaucgaucucacagacagcgaaaugaauaaacuguucgagaagaccaaaaagcagcuuagagaaaacgcggaggauauggggaauggaugcuuuaagauuuaccacaaaugugacaacgccugcaucggcucuauucggaaugggaccuauaaccaugaugucuacagagacgaggcucugaauaaccgcuuccagaucaagggcguggaacucaaauccggauacaaggacuggauucuguggaucagcuuugccaucuccugcuuccuucuguguguugcccuccugggcuuuauuaugugggcuugccaaaaagggaauauccgguguaacauuugcaucuga

SEQ ID NO: 193001 - RNA, 1701 nt, Artificial Sequence; identical to SEQ ID NO: 192098
  derived and/or modified sequence opt5 from hemagglutinin__InfluenzaA__AGK63027

SEQ ID NO: 193002 - RNA, 1701 nt, Artificial Sequence
  derived and/or modified sequence opt5 from hemagglutinin__InfluenzaA__AGK63029
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccucuggacgcauuacaguuuccaccaagagaagccagcaggcugugaucccgaauauuggcucccggccccgcgucagaaacaucccuucucgggugagcaucuauuggacaauugugaaacccggggacauccugcugauuaauuccaccggaaaccucaucgccccucgcggcuacuucaagauuagaagcgggaaaucuuccaucaugcggagcgaugcucccaucggaaaguguaauucugccugcauuaccacaaacggcagcaucccgaaugacaagccuuuucagaacgucaaucgcauuacguacggcgcgugucccagauauguuaaacaaaacacccugaaacuugccacagggaugcggaaugugccugaaaaacagacccgcggaaucuucggcgcuauugccggguuuaucgagaacggaugggaaggcaugguggacgggugguacggauucagacaccaaaauuccgagggccggggccaggcugccgaucugaagucuacacaggccgcuaucgaccagauuaacgggaaacucaacagacugaucggaaagaccaaugagaaauuccaucagauugaaaaggaguuuagcgaagucgagggccgcauccaagaucuugaaaaguauguggaggacacgaaaauugaucugugguccuacaacgcggagcuccugguugcccuggaaaaucagcacacaaucgaccucaccgauagcgagaugaacaagcuguucgaaaagaccaagaaacagcuucgggagaaugcugaagacauggggaacggaugcuuuaagauuuaucauaagugugauaaugccugcaucggcucuaucagaaacgggacauacgaccacgauguguaucgcgacgaggcccugaauaaccgguuccagauuaaaggcgucgagcucaaguccggauacaaagacuggauccuguggauuagcuuugcuaucucuugcuuccuucuguguguggcccuccugggcuuuauuaugugggcgugccaaaaggggaauaucagauguaacaucugcauuuga

SEQ ID NO: 193003 - RNA, 1701 nt, Artificial Sequence
  derived and/or modified sequence opt5 from hemagglutinin__InfluenzaA__AGK63031
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucagaaaaagaaaugggaucuguucgucgagagaagcaaggcccauuccaacuguuauccuuacgacgugcccgauuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaaugucauuaugcccaacaacgagcaguucgacaaacuguauaucuggggcgugcaucacccugggaccgauaaggaccagauuuuucucuacgcgcaagccucuggacgcaucacgguuuccacaaaaagaagccagcaggcugugauuccgaauaucggcucccggccccgcgucagaaacaucccuucucgggugagcauuuauuggaccaucgugaagcccggggauauucugcugaucaauuccacaggaaaccucauugccccucgcggcuacuucaaaaucagaagcgggaagucuuccaucaugcggagcgacgcucccauuggaaaguguaauucugccugcaucaccccgaacggcagcauuccuaaugacaaacccuuucagaacgucaaucgcaucaccuacggcgcguguccuagauauguuaagcaaaacacacugaaacuugccacggggaugcggaaugugcccgaaaagcagacccgcggaauuuucggcgcuaucgccggguuuaucgagaacggaugggaaggcaugguggaugggugguacggauucagacaccaaaauuccgagggccggggccaagcugccgaccugaaaucuacacaggccgcuauugaucagaucaacgggaagcucaauagacugauuggaaaaaccaacgagaaacuucaucagaucgaaaaggaguucagcgaagucgagggccgcauucuggaccucgaaaaauauguggaggauacaaagaucgaccugugguccuacaacgcggagcugcucguugcccuggaaaaucaacacaccauugaucuuacggacagcgagaugaacaaacuguuugaaaagacaaagaagcagcuccgggagaaugcugaagauauggggaacggaugcuucaagaucuaucauaaaugugacaaugccugcaucggcucuauuagaaacgggaccuacgaucacgacguguaucgcgacgaggcccugaauaaccgguuucagaucaagggcgucgagcuuaaauccggauacaaggauuggauucuguggaucagcuucgcuauuucuugcuuucuccuguguguggcccugcucggcuucaucaugugggcgugccagaaagggaauaucagauguaacauuugcaucuga

SEQ ID NO: 193004 - RNA, 1701 nt, Artificial Sequence
  derived and/or modified sequence opt5 from hemagglutinin__InfluenzaA__AGK63033
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucugaucgucgagagaagcaaagccuauuccaauuguuacccuuaugacgugcccgauuacgcuucucuccggagccugguugccuccagcgggacgcuugaguucaacaaugaaucuuuuaacuggaccggagugacacagaauggcaccuccagcgcuugcauucgcaagucuaacuccagcuucuuuucuagacugaauuggcucacacaucugaacuucaaguauccugcccuuaaugucaccaugcccaacaacgagcaguuugacaaacuguacaucuggggcgugcaccauccugggacggauaaggaccagauuuuccucuaugcgcaagccuccggacggaucacaguuagcaccaaacgcucccagcaggcugugauuccgaauaucggcucuagaccccggauccgcaacauuccuagcagaaucuccauuuacuggacaaucgucaagcccggggauauucugcugaucaauagcaccggaaaccucaucgccccucggggcuacuuuaaaauucgcucugggaaguccagcaucaugagaucugacgcucccauuggaaaguguaauagcgaaugcaucaccccgaacggcuccauuccuaaugacaaacccuuccagaacgugaaucggaucacauauggcgccuguccucgcuacgugaagcaaucuacgcugaaacuugcgaccgggaugagaaacguccccgagaagcagacacggggaaucuuuggcgccauugcuggguucaucgaaaauggaugggagggcaugguugaugggugguauggauuucgccaccagaacagcgagggcagaggccaagccgcugaccugaaauccacccaggccgccauugaucagaucaaugggaagcucaaccggcugauuggaaaaacaaaugaaaaguuccaccagaucgagaaggaguucagcgaaguggaaggccgcauucaagaccuugagaaauacguggaggauaccaagaucgaccuguggucuuauaacgcugaacuccuggucgcgcuggagaaccagcauacgaucgaucucacagacuccgaaaugaauaaacuguuugagaagaccaaaaagcagcuuagagaaaacgccgaggauauggggaauggaugcuucaagauuuaccacaaaugugacaacgcuugcaucggcagcauucggaaugggaccuaugaucaugacguguacagagacgaggcccugaacaaucgcuuucagaucaagggcguugaacucaaaucuggauacaaggauuggauucuguggaucuccuucgccaucagcugcuuucuucuguguguggcucuccugggcuucauuaugugggccugccaaaaagggaacauccgguguaauauuugcaucuga

SEQ ID NO: 193005 - RNA, 1701 nt, Artificial Sequence
  derived and/or modified sequence opt5 from hemagglutinin__InfluenzaA__AGK63035
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcaucagaaauaucccuucucggauuagcaucuacuggacaauugucaaacccggggauauccugcugauuaacuccaccggaaaucucaucgccccucgcggcuacuucaagaucagaagcgggaaaucuuccauuaugcggagcgacgcucccaucggaaaguguaacucugaaugcauuaccccgaauggcagcaucccuaacgacaagcccuuucagaaugugaaccgcauuacauauggcgccuguccuagauacgugaaacaauccacgcugaagcuggcgaccgggaugcggaauguccccgagaaacagacacgcggaaucuucggcgccaucgcuggguuuauugaaaacggaugggagggcaugguugaugggugguauggauucagacaccaaaauucugagggccggggccaggccgcugaccuuaagagcacccaggccgccaucgaucagauuaacgggaaacucaauagacugaucggaaagacaaacgaaaaauuccaccagauugagaaggaauuuuccgagguggaaggccgcauccaagaccuugagaaguacguggaggauaccaaaauugaccuguggagcuauaacgcugaacuccuggucgcgcuggagaaucagcauacgaucgaucucacagacucugaaaugaacaagcuguucgagaaaaccaagaaacagcuucgggaaaaugccgaggauauggggaacggaugcuuuaagaucuaccacaagugugacaaugcuugcauuggcuccaucagaaacgggaccuaugaucaugacguguaccgcgacgaggcccugaauaaccgguuccagauuaaaggcguugaacucaagagcggauacaaagauuggauccuguggauuucuuuugccaucuccugcuuccuucuguguguggcucuccugggcuuuaucaugugggccugccaaaaggggaauauuagauguaacaucugcauuuga

SEQ ID NO: 193006 - RNA, 1701 nt, Artificial Sequence
  derived and/or modified sequence opt5 from hemagglutinin__InfluenzaA__AGK63037
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgaaaucugcaauucuccgcaccagauccuugacggggagaacuguacccugauugaugcccuccugggagacccccagugcgauggcuuucaaaauaagaaaugggaccuguucgucgaaagaagcaaggcccauuccaacuguaauccuuaugaugugcccgacuacgcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaacuuuaaauauccugcccuuaaugucaccaugcccaacaaugaacaguucgauaagcuguacauuuggggcgugcaucacccugggacggacaaggaucagaucuuucucuaugcgcaagccucuggacgcauuacaguuuccaccaaaagaagccagcaggcugugaucccgaacauuggcucccggccccgcgucagaaauaucccuucucgggugagcaucuacuggacaauugugaagcccggggacauccugcugauuaacuccaccggaaaucucaucgccccucgcggcuauuucaaaauuagaagcgggaagucuuccaucaugcggagcgaugcucccaucggaaaauguaacucugccugcauuaccccgaauggcagcaucccuaacgacaagcccuuucagaaugucaaccgcauuacauacggcgcguguccuagauacguuaagcaaaauacgcugaaacuugccaccgggaugcggaacgugcccgagaagcagacacgcggaaucuucggcgcuauugccggguuuaucgaaaauggaugggagggcaugguggacgggugguauggauucagacaccagaacuccgagggccggggccaagcugccgaucugaaaucuacccaggccgcuaucgaccagauuaacgggaagcucaauagacugaucggaaaaacaaacgaaaaguuccaucagauugagaaagaauuuagcgaggucgaaggccgcauccaagaucuugagaaguacguggaggacaccaagauugaucugugguccuauaaugcgcagcuccugguugcccuggaaaaccagcacacgaucgaccucacagauagcgagaugaauaaacuguucgaaaagaccaaaaagcagcuucgggagaacgcugaagacauggggaauggaugcuuuaaaauuuaccauaagugugauaacgccugcaucggcucuaucagaaaugggaccuaugaccacgauguguaccgcgacgaggcccugaacaaucgguuccaaauuaagggcgucgagcucaaauccggauauaaggacuggauccuguggauuagcuuugcuaucucuugcuuccuucuguguguggcccuccugggcuuuauuaugugggcgugccagaaagggaacaucagauguaauaucugcauuuga

SEQ ID NO: 193007 - RNA, 1701 nt, Artificial Sequence
  derived and/or modified sequence opt5 from hemagglutinin__InfluenzaA__AGK63039
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucagaaaaagaaaugggaccuguucgucgagagaagcaaggcccauuccaauuguuauccuuacgaugugcccgacuaugcuucucuccggagccugguugccuccagcgggacgcuugaauuuaacaaugagucuuucaacuggaccggagugacacaaaauggcaccuccagcgcuugcauccgcagaucuaacaauuccuuuuucagccggcugaacuggcucacacaccugaauuuuaaguacccugcccuuaacgucacccugcccaacaaugagcaguucgauaaacucuauauuuggggcgugcaucacccugggacggacaaggaucagaucuuucuguacgcgcaagccucuggacgcauuacaguuuccaccaaaagaagccagcaggcugugaucccgaacauuggcucccggccccgcgucagaaauaucccuucucgggugagcaucuauuggacaauugugaagcccggggacauccugcucauuaacuccaccggaaaucugaucgccccucgcggcuacuucaaaauuagaagcgggaagucuuccaucaugcggagcgaugcucccaucucuaaguguaacagcgccugcauuaccccgaauggauccaucccuaacgacaaacccuuucagaaugucaaccgcauuacauacggcgcguguccuagauauguuaagcaaaauacgcuuaaacuggccaccggcaugcggaacgugcccgaaaagcagacacgcgggaucuucggagcuauugccggcuuuaucgagaaugggugggaaggaaugguggacggcugguacggguucagacaccagaacucugagggacggggccaagcugccgaucucaaaagcacccaggccgcuaucgaccagauuaauggcaagcugaacagacuuaucgggaaaacaaacgagaaguuccaucagauugaaaaggaguuuuccgaagucgagggacgcauccaagaucuggaaaaauauguggaggacaccaagauugaucucuggagcuacaaugcggagcugcugguugcccucgaaaaccagcacacgaucgaccugacagauucugagaugaauaaacuuuucgaaaagaccaaaaagcagcugcgggagaacgcugaagacaugggcaaugggugcuuuaagauuuaucauaaaugugauaacgccugcaucggauccaucagaaauggcaccuacgaccacgauguguaucgcgacgaggcccucaacaaucgguuccagauuaagggggucgagcugaaaagcggcuacaaggacuggauccuuuggauuucuuuugcuaucuccugcuuccugcucuguguggcccugcugggauuuauuauguggagcugccaaaaaggcaacaucagauguaauaucugcauuuga

SEQ ID NO: 193008 - RNA, 1701 nt, Artificial Sequence
  derived and/or modified sequence opt5 from hemagglutinin__InfluenzaA__AGK63041
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggccugcaaaacaaaaagugggaucucaucgucgagagaagcaaagcccauuccuauuguuacccuuaugacgugcccgauuacgcuucucugcggagccuuguugccuccagcgggacgcuggaauuuaauaacgagucuuucaauuggaccgaggugacacagaacggaaccuccagcgcuugcauucgcagaucuaauaacuccuuuuucagccggcucaauuggcugacacaccuuaacuuuaaguauccugcccugaaugucaccaugcccaacaacgaacaguucgacaagcucuacaucuggggcgugcaucacccuggcacggauaaagaccagauuuuucuguaugcgcaagccucugggcgcaucacaguuuccaccaagagaagccagcaggcugugauuccgaauaucggaucccggccccgcgucagaaacaucccuucucgggugagcauuuacuggacaaucgugaaacccggcgauauucugcucaucaauuccaccgggaaccugauugccccucgcggauacuucaagaucagaagcggcaaaucuuccaucaugcggagcgacgcucccauugggaaguguaauucugccugcaucaccccgaacggaagcauuccuaaugacaagcccuuucagaacgucaaucgcaucacauauggcgcguguccuagauacguuaaacaaaacacgcuuaagcuggccaccggcaugcggaaugugcccgagaaacagacacgcgggauuuucggagcuaucgccggcuuuaucgaaaacgggugggagggaaugguggauggcugguauggguucagacaccaaaauuccgagggacggggccaggcugccgaccucaagucuacccaggccgcuauugaucagaucaacggcaaacugaauagacuuauugggaagacaaacgaaaaauuucaucagaucgagaaggaguucagcgaagucgaaggacgcauucaagaccuggagaaguacguggaggauaccaaaaucgaccucugguccuauaacgcggaacugcugguugcccucgagaaucagcacacgauugaucugacagacagcgaaaugaacaaacuuuucgagaagaccaagaaacagcugcgggaaaaugcugaggauaugggcaacgggugcuuuaagaucuaccauaagugugacaaugccugcaucggaucuauuagaaacggcaccuaugaucacgacguguaccgcgacgaggcccucaauaaccgguuccagaucaaaggggucgaacugaaguccggcuacaaagauuggauucuuuggaucagcuuugcuauuucuugcuuccugcucuguguggcccugcugggauuuaucaugugggcgugccaaaagggcaauaucagauguaacauuugcaucuga

SEQ ID NO: 193009 - RNA, 1701 nt, Artificial Sequence
  derived and/or modified sequence opt5 from hemagglutinin__InfluenzaA__AGK63043
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucgggugagcaucuacuggacaauugugaaacccggggauauccugcugauuaacuccaccggaaaucucaucgccccucgcggcuacuucaagauuagaagcgggaaaucuuccaucaugcggagcgacgcucccaucggaaaguguaacucugccugcauuaccccgaauggcagcaucccuaacgacaagcccuuucagaaugucaaccgcauuacauauggcgcguguccuagauacguuaaacaauccacgcugaaacuugccaccgggaugcggaaugugcccgaaaaacagacacgcggaaucuucggcgcuauugccggguuuaucgagaacggaugggaaggcaugguggaugggugguauggauucagacaccagaauagcgagggccggggccaagcugccgaccugaagucuacccaggccgcuaucgaucagauuaacgggaaacucaauagacugaucggaaagacaaacgagaaauuccaccagauugaaaaggaguuuuccgaagucgagggccgcauccaagaccuugaaaaguacguggaggauaccaaaauugaccuguggagcuauaacgcggagcuccugguugcccuggaaaaucagcauacgaucgaucucacagacucugagaugaacaagcuguucgaaaagaccaagaaacagcuucgggagaaugcugaagauauggggaacggaugcuuuaagauuuaccacaagugugacaaugccugcaucggcuccaucagaaacgggaccuaugaucaugacguguaccgcgacgaggcccugaauaaccgguuccagauuaaaggcgucgagcucaagagcggauacaaagauuggauccuguggauuucuuuugcuaucuccugcuuccuucuguguguggcccuccugggcuuuauuaugugggcgugccaaaaggggaauaucagauguaacaucugcauuuga

SEQ ID NO: 193010 - RNA, 1701 nt, Artificial Sequence
  derived and/or modified sequence opt5 from hemagglutinin__InfluenzaA__AGK63045
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaagaagaaaugggaccuguucgucgagagaagcaaggccuauuccaauuguuacccuuaugaugugcccgacuacgcuucucuccggagccugguugccuccagcgggacgcuugaauuuaacaaugagucuuucaacuggaccggagugacacagaauggcaccuccagcgcuugcauccgcaagucuaacuccagcuuuuucucuagacugaauuggcucacacaucugaacuuuaaauauccugcccuuaaugucaccaugcccaacaacgagcaguucgauaagcuguacauuuggggcgugcaccauccugggacggacaaagaucagaucuuucucuaugcgcaagccuccggacggauuacaguuagcaccaagcgcucccagcaggcugugaucccgaauauuggcucuagaccccggauccgcaacaucccuagcagaauuuccaucuacuggacaauugucaaacccggggacauccugcugauuaauagcaccggaaaccucaucgccccucggggcuacuucaagauccgcucugggaaguccagcauuaugagaucugaugcucccaucggaaaauguaauagcgaaugcauuaccccgaacggcuccaucccuaaugacaagcccuuucagaacgugaaucggauuacauauggcgccuguccucgcuacgugaaacaaucuacgcugaaacuugcgaccgggaugagaaacguccccgagaaacagacacggggaaucuucggcgccaucgcuggguuuauugaaaauggaugggagggcaugguugacgggugguauggauuccgccaccagaacagcgagggcagaggccaagccgcugaucugaaguccacccaggccgccaucgaccagauuaaugggaaacucaaccggcugaucggaaagacaaaugaaaaguuccaccagauugagaaagaauuuagcgagguggaaggcagaauccaagaucuugagaaguacguggaggacaccaaaauugaucuguggucuuauaacgcucagcuccuggucgcgcuggaaaaccagcauacgaucgaccucacagauuccgagaugaauaagcuguucgagaaaaccaagaagcagcuucgcgaaaacgccgaagacauggggaauggaugcuuuaaaaucuaccacaagugugauaacgcuugcauuggcagcauccggaaugggaccuaugaccaugauguguacagagacgaggcccugaacaaucgcuuccaaauuaaaggcguugagcucaagucuggauacaaagacuggauccuguggauuuccuuugccaucagcugcuuccuucuguguguggcucuccugggcuuuaucaugugggccugccagaaggggaacauucgguguaauaucugcauuuga

SEQ ID NO: 193011 - RNA, 1701 nt, Artificial Sequence
  derived and/or modified sequence opt5 from hemagglutinin__InfluenzaA__AGK63047
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgacagagaggggcggaugaacuacuauuggacgcugauugaacccggagauaagaucacauucgaggccaccggcaaccugguugugccucgcuacgcguuugccauggaaagaaaugcugggagcggaauuaucaucucugacacacccgugcaugauugcaacaccgccugucagaccccugagggcgcuauuaauacaucccuccccuuccaaaacauccacccgauuacgaucggcaaaugcccuaaguaugucaagagcaccaaacugcggcuugccacagggcugcgcaaugugcccucuauucagagcagaggacucuuuggcgccaucgcuggguucaucgaaggaggcuggaccgggaugguugacggaugguacggcuaucaucaccagaacgagcagggcuccggguacgcggccgaccugaagucuacacaaaaugcuauugauaaaaucaccaacaaggugaauagcgucauugagaaaaugaacacgcaguuuacagccgugggaaaggaguucaaucaccuugagaagcggaucgaaaaccugaauaaaaagguugacgauggcuuccucgacauuuggaccuacaacgccgagcugcuggugcuccuggaaaaugagcgcacccuugauuaucaugacuccaacgucaaaaaccuguacgagaaggugagaaaucagcucaaaaacaaugcuaaggaaaucgggaacggauguuuugaguucuaucacaagugcgauaauacauguauggaaagcgucaaaaacggcaccuacgacuauccuaaguacucugaggaagccaaacugaaucgggagaagaucgauggggugaaacuugaguccacacgcauuuaucagauccuggcgauuuacagcacgguugcuucuucccucgugcuggucgugagccugggcgccaucuccuuuuggaugugcucuaacggaagccuccaaugcagaauuuguaucuga

SEQ ID NO: 193012 - RNA, 1683 nt, Artificial Sequence
  derived and/or modified sequence opt5 from hemagglutinin__InfluenzaA__AGK82158
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuaucgcgccugaucgcgccucuuuccugagagggaaaagcaugggcauucaguccggaguucagguggacgcuaacugcgaaggggauuguuaccauagcggaggcacaaucauuucuaaucuccccuuucagaacaucgacucccgggccgugggcaagugcccucgcuaugucaagcaaagaagccugcugcucgcuacggggaugaaaaaugugcccgagauuccgaagggacggggccuguucggggccaucgccggauucaucgaaaacggcugggaggggcuuauugauggcugguacggauuuagacaccagaaugcucagggcgaagggaccgcggccgacuacaaaucuacacaaagcgcuaucgaccagauuaccggaaagcugaaccgccucaucgagaaaacaaaucagcaguucgagcugauugauaacgaauuuaaugagguugaaaagcaaaucggcaacgugaucaauuggacccgggacuccauuacggaggucuggucuuauaacgccgaacuucugguggccauggagaaucagcacacaaucgaucucgcugacagcgagauggauaaacuguacgaaagaguuaagcgccagcugcgggagaacgccgaagaggacgggaccggauguuucgaaauuuuucauaagugcgaugacgauuguauggcguccaucagaaauaacaccuaugaccacagcaaauaccgcgaggaggcuaugcagaaccggauucaaaucgauccugugaagcucucuuccggcuauaaagacgucauucugugguucagcuuuggggccucuugcuucauccuucuggccaucgugaugggccucgucuuuauuugcgugaagaauggaaacaugagauguacaaucugcauuuga

SEQ ID NO: 193013 - RNA, 1683 nt, Artificial Sequence
  derived and/or modified sequence opt5 from hemagglutinin__InfluenzaA__AGK84857
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaucaccaagagcuauaaaaacacgcgcaagucuccugcucugauuguguggggcauccaccauuccguuagcacagccgagcagaccaaacuuuacgggucuggaaauaagcuggugacagucggcuccagcaacuaucagcagucuuuugugcccuccccuggcgcuagaccgcaagugaaugggcucagcggacggaucgauuuccacuggcugaugcuuaaccccaaugacaccgucaccuuuuccuucaacggcgccuuuauugcgccugaucgcgccucuuuccugagagggaaaagcaugggaauccaguccggcguucagguggacgcuaacugcgaaggggauuguuaccauagcggaggcacaauuaucucuaaucuccccuuucagaacauugacucccgggccgugggcaagugcccucgcuaugucaagcaaagaagccugcugcucgcuacggggaugaaaaaugugcccgagaucccgaagggacggggccuguucggggccaucgccggauucauugaaaacggcugggaggggcuuaucgauggcugguacggauuuagacaccagaaugcucagggcgaagggaccgcggccgacuacaaaucuacacaaagcgcuauugaccagaucaccggaaagcugaaccgccucauugagaaaacaaaucagcaguucgagcugaucgauaacgaauuuaaugagguugaaaagcaaaucggcaacgugauuaauuggacccgggacuccaucacggaggucuggucuuauaacgccgaacuucugguggccauggagaaucagcacacaauugaucucgcugacagcgagauggauaaacuguacgaaagaguuaagcgccagcugcgggagaacgccgaagaggacgggaccggauguuucgaaaucuuucauaagugcgaugacgauuguauggcguccauuagaaauaacaccuaugaccacagcaaauaccgcgaggaggcuaugcagaaccggauccaaauugauccugugaagcucucuuccggcuauaaagacgucauccugugguucagcuuuggggccucuugcuucauccuucuggccauugugaugggccucgucuuuaucugcgugaagaauggaaacaugagauguacaauuugcaucuga

SEQ ID NO: 193014 - RNA, 1683 nt, Artificial Sequence
  derived and/or modified sequence opt5 from hemagglutinin__InfluenzaA__AGK84860
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaaugacaguugaucuggggcaaugcggacuccugggcaccaucacggggccgccccagugugaccaguuucuugaguucucugccgaucugauuaucgaaagacgggagggaagcgacgugugcuacccuggcaaguuugucaacgaggaagcccuccgccagauucugagagaguccggcgggaucgauaaagaagcuaugggauucaccuauucuggcauucggacaaauggggccaccagcgcuugucgcagauccggaucuagcuuuuacgccgagaugaaguggcugcucuccaacacagacaaugcggccuucccccaaaugaccaagagcuauaaaaacacgcggaagucuccugcucugaucguguggggcauucaccauuccguuagcacagccgagcagaccaaacuuuacgggucuggaaauaagcuggugacagucggcuccagcaacuaucagcagucuuuugugcccuccccuggcgcucgcccgcaagugaaugggcucagcggaagaaucgauuuccacuggcugaugcuuaaccccaaugacaccgucaccuuuuccuucaacggcgccuuuaucgcgccugaucgggccucuuuccugcgcgggaaaagcaugggcauucaguccggaguucagguggacgcuaacugcgaaggggauuguuaccauagcggaggcacaaucauuucuaaucuccccuuucagaacaucgacuccagagccgugggcaagugcccucgguaugucaagcaacgcagccugcugcucgcuacggggaugaaaaaugugcccgagauuccgaagggaagaggccuguucggggccaucgccggauucaucgaaaacggcugggaggggcuuauugauggcugguacggauuucggcaccagaaugcucagggcgaagggaccgcggccgacuacaaaucuacacaaagcgcuaucgaccagauuaccggaaagcugaacagacucaucgagaaaacaaaucagcaguucgagcugauugauaacgaauuuaaugagguugaaaagcaaaucggcaacgugaucaauuggacccgcgacuccauuacggaggucuggucuuauaacgccgaacuucugguggccauggagaaucagcacacaaucgaucucgcugacagcgagauggauaaacuguacgaacggguuaagagacagcugcgcgagaacgccgaagaggacgggaccggauguuucgaaauuuuucauaagugcgaugacgauuguauggcguccauccggaauaacaccuaugaccacagcaaauacagagaggaggcuaugcagaaccgcauucaaaucgauccugugaagcucucuuccggcuauaaagacgucauucugugguucagcuuuggggccucuugcuucauccuucuggccaucgugaugggccucgucuuuauuugcgugaagaauggaaacaugcgguguacaaucugcauuuga

SEQ ID NO: 193015 - RNA, 1683 nt, Artificial Sequence
  derived and/or modified sequence opt5 from hemagglutinin__InfluenzaA__AGK84863
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaaagacaguugaucuggggcaaugcggacuccugggcaccaucacggggccgccccagugugaccaguuucuugaguucucugccgaucugauuaucgaaagacgggagggaagcgacgugugcuacccuggcaaauuugucaacgaggaagcccuccgccagauucugagagaguccggcgggaucgauaaggaagcuaugggauucaccuauucuggcauucggacaaauggggccaccagcgcuugucgcagauccggaucuagcuuuuacgccgagaugaaguggcugcucuccaacacagacaaugcggccuucccccaaaugaccaaaagcuauaagaacacgcggaaaucuccugcucugaucguguggggcauucaccauuccguuagcacagccgagcagaccaaacuuuacgggucuggaaauaagcuggugacagucggcuccagcaacuaucagcagucuuuugugcccuccccuggcgcucgcccgcaagugaaugggcucagcggaagaaucgauuuccacuggcugaugcuuaaccccaaugacaccgucaccuuuuccuucaacggcgccuuuaucgcgccugaucgggccucuuuccugcgcggaaagagcauggggauucaguccggcguucagguggacgcuaacugcgaaggggauuguuaccauagcggaggcacaaucauuucuaaucuccccuuucagaacaucgacuccagagccgugggcaagugcccucgguaugucaaacaacgcagccugcugcucgcuacggggaugaagaaugugcccgagauuccgaaaggaagaggccuguucggggccaucgccggauucaucgaaaacggcugggaggggcuuauugauggcugguacggauuucggcaccagaaugcucagggcgaagggaccgcggccgacuacaagucuacacaaagcgcuaucgaccagauuaccggaaaacugaacagacucaucgagaagacaaaucagcaguucgagcugauugauaacgaauuuaaugagguugaaaaacaaaucggcaacgugaucaauuggacccgcgacuccauuacggaggucuggucuuauaacgccgaacuucugguggccauggagaaucagcacacaaucgaucucgcugacagcgagauggauaagcuguacgaacggguuaagagacagcugcgcgagaacgccgaagaggacgggaccggauguuucgaaauuuuucauaaaugcgaugacgauuguauggcguccauccggaauaacaccuaugaccacagcaaguacagagaggaggcuaugcagaaccgcauucaaaucgauccugugaaacucucuuccggcuauaaggacgucauucugugguucagcuuuggggccucuugcuucauccuucuggccaucgugaugggccucgucuuuauuugcgugaaaaauggaaacaugcgguguacaaucugcauuuga

SEQ ID NO: 193016 - RNA, 1701 nt, Artificial Sequence
  derived and/or modified sequence opt5 from hemagglutinin__InfluenzaA__AGL07713
augaaggccauccuggugguccuccuguacaccuucgcuacagccaacgcggacacgcuuugcauuggcuaucacgcuaauaacagcaccgauacaguugacaccgugcuggagaagaaugugacagucaccagauccgugaaccuccuggaagauaagcauaaugggaaacuuuguaagcugcggggaguugcuccccuccaccugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgcgagcagcuuuccagcgucucuuccuucgaaagauuugagaucuuccccaagaccggaagcuggccuaaucaugauucuaacaagggcgugacagccgcuuguccccacgccggcgcgaaaggguuuuauaagaaucugaucuggcucguugaaaaaggaaacuccuacccuaagcugagcaaaucuuauauuaaugacaagggcaaggaggugcuuguccugugggggauccaucaccccuccaccacagccgaucaacagcggcucuaccagaacgcugacaccuacguguucgugggaacgagccgcuauuccaaaaaguuuaaaccugagauugccaucagaccgaagguccgggaucaggaaggccgcaugaauuacuauuggacacugguugagcccggggacaaaauuaccuucgaagcuacaggaaaccugguggugccuagauacgccuuugcgauggagcggaacgccggcucuggcaucauuaucagcgauacccccguccacgacugcaauaccacaugucaaacgccuaagggggcuaucaacaccucccuccccuuccagaauauucauccgaucacaauuggaaaaugcccuaaguauguuaagagcaccaaacugcgccuugccacaggccugagaaacgugcccucuauccagucccgggggcucuuuggagcuauugccggcuucaucgaagggggauggaccggcaugguggacggcugguacggguaucaccaucagaaugagcaaggaagcggcuacgccgcugaucugaagucuacgcagaacgcgaucgacaaaauuacaaauaaggucaacagcgugaucgagaaaaugaauacccaguuuaccgccguugggaaggaguucaaccaccuugagaagcgcauugaaaaucugaacaaaaagguggaugacggauuccucgauaucuggacauacaaugcugagcugcugguccuccuggaaaacgagagaacccuugacuaucacgauuccaaugugaaaaaccuguacgagaagguccggaaccagcucaaaaauaacgccaaggaaauuggcaauggguguuuugaguucuaucauaagugcgacaacacauguauggaaucugugaaaaauggcacguacgauuauccuaaguacagcgaggaagccaaacugaaccgcgaggagaucgacggaguuaaacuugaauccaccagaaucuaucaaauucuggcuaucuacagcacaguggccucuucccucguccuggugguuagccugggcgcgauuucuuuuuggaugugcuccaaugggagccuccagugccggaucuguauuuga

SEQ ID NO: 193017 - RNA, 1701 nt, Artificial Sequence
  derived and/or modified sequence opt5 from hemagglutinin__InfluenzaA__AGL09731
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagacggagcaauucuuccuuuuucagccgccuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcagucuuccggaagaauuacgguuagcacaaagcggucccaacaggccgugaucccgaacaucggcucucgcccccggauuagaaauaucccuagccgcauuuccaucuacuggaccauugucaaacccggggauauccuccugaucaacagcacaggaaaucugauugcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaaucaccuauggcgcuuguccucgguacgugaagcagucuacacucaaacuggccacggggaugcgcaacguccccgagaagcaaaccagaggaauuuucggcgcgaucgccggguuuauugaaaauggaugggagggcaugguugaugggugguauggauuccggcaccagaacagcgagggcagaggccaggcugccgaccuuaaauccacacaagcugccaucgaucagauuaaugggaagcugaaccgccucaucggaaaaaccaaugaaaaguuccaccagauugagaaggaauuuagcgagguggaaggccggauccaggaccuggagaaauacguggaggauacaaagaucgaccuuuggucuuauaacgccgaacugcucgucgcucuggagaaccaacauaccauugaucugacggacuccgaaaugaauaaacucuucgagaagacaaagaagcagcugagagaaaacgcggaggauauggggaauggaugcuuuaagaucuaccacaaaugugacaacgccugcauuggcagcauccgcaaugggaccuaugaucaugacguguaccgggacgaggcucuuaacaauagauuccagauuaagggcguugaacugaaaucuggauacaaggauuggauccucuggaucuccuuugccauuagcugcuuccugcuuuguguggcccugcucggcuuuaucaugugggcuugccagaaagggaacauucgcuguaauaucugcauuuga

SEQ ID NO: 193018 - RNA, 1701 nt, Artificial Sequence
  derived and/or modified sequence opt5 from hemagglutinin__InfluenzaA__AGL09732
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucuguguguggcucuccugggguuuauuaugugggccugccagaaaggaaacaucagauguaauauuugcaucuga

SEQ ID NO: 193019 - RNA, 1701 nt, Artificial Sequence
  derived and/or modified sequence opt5 from hemagglutinin__InfluenzaA__AGL09734
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugauagaauugaggugacaaacgcuaccgaacucgugcaaaauucuagcaucggcgagaucugcgacuccccgcaccagauucuggauggggaaaacuguacacuuaucgacgcccugcucggagauccccagugcgacggcuuccagaauaaaaagugggaucuguuuauugagcggucuaaagccuauagcaacuguuacccuuaugacguccccgauuacgcuucccugcgcucucucguggccagcuccgggacccuggaauuuaauaacgagagcuucaauuggacgggaguuacccaaaacggcacaucuuccgcuugcaucagacggagcaauucuuccuucuuuagccgccuuaacuggcugacccaucucaauuucaaguauccugcccugaacgugacaaugcccaacaaugagcaguuugacaaacuuuacauuuggggcguccaccauccugggaccgauaaagaccagaucuuccuguaugcgcagucuuccggaagaauuacggugagcacaaagcggucccaacaggccguuaucccgaacaucggcucucgcccccggauuagaaauaucccuagccgcauuuccaucuacuggaccauugugaaacccggggauauccuccugaucaacagcacaggaaaucugauugcuccuagaggcuacuuuaagauccggucugggaaauccagcauuaugcgcucugacgcccccaucggaaaguguaagagcgaaugcauuaccccgaacggcuccaucccuaaugacaaacccuuccagaacgucaauagaaucaccuauggcgcuuguccucgguacgugaagcagucuacacucaaacuggccacggggaugcgcaacgugcccgagaagcaaaccagaggaauuuuuggcgcgaucgccggguucauugaaaauggaugggagggcauggucgaugggugguauggauuccggcaccagaacagcgagggcagaggccaggcugccgaccuuaaauccacacaagcugccaucgaucagauuaaugggaagcugaaccgccucaucggaaaaaccaaugaaaaguuucaccagauugagaaggaguucagcgaaguugaaggccggauccaggaccuggagaaauacguggaggauacaaagaucgaccuuuggucuuauaacgccgaacugcucguggcucuggagaaccaacauaccauugaucugacggacuccgaaaugaauaaacucuuugagaagacaaagaagcagcugagagaaaacgcggaggauauggggaauggaugcuucaagaucuaccacaaaugugacaacgccugcauuggcagcauccgcaaugggaccuaugaucaugacgucuaccgggacgaggcucuuaacaauagauuucagauuaagggcguggaacugaaaucuggauacaaggauuggauccucuggaucuccuucgccauuagcugcuuucugcuuuguguugcccugcucggcuucaucaugugggcuugccagaaagggaacauucgcuguaauaucugcauuuga

SEQ ID NO: 193020 - RNA, 1701 nt, Artificial Sequence
  derived and/or modified sequence opt5 from hemagglutinin__InfluenzaA__AGL09735
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacguguaccgcgacgaggcccugaacaaucgguuccagaucaagggaguugaacucaaaucuggcuacaaggauuggauucuguggaucuccuuugccaucagcugcuuccuucuguguguggcucuccugggguuuauuaugugggccugccagaaaggaaacaucagauguaauauuuccaucuga

SEQ ID NO: 193021 - RNA, 1701 nt, Artificial Sequence
  derived and/or modified sequence opt5 from hemagglutinin__InfluenzaA__AGL09736
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucgcucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgugaagcaaucuacccugaaacuugcgacaggaaugagaaacguccccgagaagcagacgcggggcaucuucggggccauugcuggauuuaucgaaaauggcugggaggggaugguugauggaugguauggcuuccgccaccagaacagcgagggcagagggcaagccgcugaccugaaauccacccaggccgccauugaucagaucaauggaaagcucaaccggcugauuggcaaaacaaaugaaaaguuccaccagaucgagaaggaauuuagcgagguggaagggcgcauucaagaccuugagaaauacguggaggauaccaagaucgaccuguggucuuauaacgcugaacuccuggucgcgcuggagaaccagcauacaaucgaucucaccgacuccgaaaugaauaaacuguucgagaagacgaaaaagcagcuuagagaaaacgccgaggauaugggaaauggcugcuuuaagauuuaccacaaaugugacaacgcuugcaucgggagcauucggaauggcacauaugaucaugacguguacagagacgaggcccugaacaaucgcuuccagaucaagggaguugaacucaaaucuggcuacaaggauuggauucuguggaucuccuuugccaucagcugcuuccuucuguguguggcucuccugggguuuauuaugugggccugccaaaaaggaaacauccgguguaauauuugcaucuga

SEQ ID NO: 193022 - RNA, 1701 nt, Artificial Sequence; identical to SEQ ID NO: 192907
  derived and/or modified sequence opt5 from hemagglutinin__InfluenzaA__AGL09737

SEQ ID NO: 193023 - RNA, 1701 nt, Artificial Sequence
  derived and/or modified sequence opt5 from hemagglutinin__InfluenzaA__AGL09739
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcuccuguuacccuuaugacgugcccgauuacgcuucucuccgcagccugguugccuccagcgggacccuugaauuuaacaaugagucuuucaacuggacgggagugacccaaaauggcacauccagcgcuugcauuagacggucuaacuccagcuuuuucucucgccugaauuggcucacccaucugaacuuuaaguauccugcccuuaaugucacaaugcccaacaacgagcaguucgacaagcuguacaucuggggcgugcaccauccugggaccgauaaagaccagauuuuucucuaugcgcaguccagcggaagaaucacgguuuccacaaagcggucucaacaggccgugauuccgaauaucggcagccgccccagaauccggaacauuccuucccgcaucagcauuuacuggaccaucgucaaacccggggauauucugcugaucaauucuacaggaaaccucaucgcuccuagaggcuacuucaagauucgguccgggaaaagcucuaucaugcgcagcgacgcccccauuggaaaguguaaguccgaaugcaucaccccgaauggcucuauuccuaacgacaaacccuuucagaaugugaacagaaucaccuauggcgcuuguccucgguacgugaagcagagcacacugaaacuugccacggggaugcgcaauguccccgagaagcaaaccagaggaaucuucggcgcgauugccggguuuaucgaaaacggaugggagggcaugguugaugggugguauggauuccggcaccaaaauuccgagggcagaggccaggcugccgaccugaaaagcacacaggcugccauugaucagaucaacgggaagcucaaucgccugauuggaaaaaccaacgaaaaguuccaccagaucgagaaggaauuuucugagguggaaggccggauucaggaccuugagaaauacguggaggauacaaagaucgaccugugguccuauaaugccgaacuccuggucgcucuggagaaccaacauaccaucgaucucacggacagcgaaaugaacaaacuguucgagaagaccaaaaagcagcuuagagaaaaugcggaggauauggggaacggaugcuuuaagauuuaccacaaaugugacaaugccugcaucggcucuauucgcaacgggacauaugaucauaauguguaccgggacgaggcucugaacaauagauuccagaucaagggcguugaacucaaauccggauacaaggacuggauucuguggaucagcuuugccaucuccugcuuccuucuguguguggcccuccugggcuuuauuaugugggcuugccagaaagggaacauccgcuguaauauuugcaucuga

SEQ ID NO: 193024 - RNA, 1701 nt, Artificial Sequence; identical to SEQ ID NO: 192859
  derived and/or modified sequence opt5 from hemagglutinin__InfluenzaA__AGL09740

SEQ ID NO: 193025 - RNA, 1701 nt, Artificial Sequence; identical to SEQ ID NO: 192098
  derived and/or modified sequence opt5 from hemagglutinin__InfluenzaA__AGL09741

SEQ ID NO: 193026 - RNA, 1701 nt, Artificial Sequence
  derived and/or modified sequence opt5 from hemagglutinin__InfluenzaA__AGL09742
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacaaugagucuuucaacuggaccggagugacacagaauggcaccuccagcgcuugcauccgcagaucuaacaauuccuuuuucagccggcugaacuggcucacacaccugaauuuuaaauacccugcccuuaacgucaccaugcccaacaaugaacaguucgacaagcuguauauuuggggcgugcaucacccugggacggauaaggaccagaucuuucucuacgcgcaagccucuggacgcauuacaguuuccaccaaaagaagccagcaggcugugaucccgaacauuggcucccggccccgcgucagaaauaucccuucucgggugagcaucuauuggacaauugugaagcccggggauauccugcugauuaacuccaccggaaaucucaucgccccucgcggcuacuucaaaauuagaagcgggaagucuuccaucaugcggagcgacgcucccaucggaaaauguaacucugccugcauuaccccgaauggcagcaucccuaacgacaagcccuuucagaaugucaaccgcauuacauacggcgcguguccuagauauguuaagcaaaauacgcugaaacuugccaccgggaugcggaacgugcccgagacacagacccgcggaaucuucggcgcuauugccggguuuaucgaaaauggaugggagggcaugguggaugggugguacggauucagacaccagaacuccgagggccggggccaagcugccgaccugaagucuacacaggccgcuaucgaucagauuaaugggaaacucaacagacugaucggaaagaccaacgaaaaauuccaucagauugagaaggaauuuagcgaggucgaaggccgcauccaagaccuugagaaauauguggaggauacgaagauugaccugugguccuacaaugcggaacuccugguugcccuggagaaccagcacacaaucgaucucaccgacagcgaaaugaauaagcuguucgagaaaaccaagaaacagcuucgggaaaacgcugaggauauggggaauggaugcuuuaagauuuaucauaaaugugacaacgccugcaucggcucuaucagaaaugggacauacgaucacgacguguaucgcgacgaggcccugaacaaucgguuccagauuaagggcgucgaacucagauccggauacaaggauuggauccuguggauuagcuuugcuaucucuugcuuccuucuguguguggcccuccugggcuuuauuaugugggcgugccaaaaagggaacauccgcuguuccaucugcauuuga

SEQ ID NO: 193027 - RNA, 1701 nt, Artificial Sequence; identical to SEQ ID NO: 192882
  derived and/or modified sequence opt5 from hemagglutinin__InfluenzaA__AGL09744

SEQ ID NO: 193028 - RNA, 1701 nt, Artificial Sequence
  derived and/or modified sequence opt5 from hemagglutinin__InfluenzaA__AGL09745
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauguggggaauggaugcuuuaagauuuaccacaaaugugacaacacaugcaucggcagcauucgcaaugggaccuaugaucauaacguuuaccgggacgaggcccugaauaacagauuccagaucaagggcguggaacucaaaucuggauacaaggacuggauucuguggaucuccuuugcuaucagcugcuuccuucugugugucgcccuccugggcuuuauuaugugggccugccagaaagggaauauccgcuguaacauuugcaucuga

SEQ ID NO: 193029 - RNA, 1701 nt, Artificial Sequence; identical to SEQ ID NO: 193021
  derived and/or modified sequence opt5 from hemagglutinin__InfluenzaA__AGL09746

SEQ ID NO: 193030 - RNA, 1701 nt, Artificial Sequence; identical to SEQ ID NO: 192859
  derived and/or modified sequence opt5 from hemagglutinin__InfluenzaA__AGL09747

SEQ ID NO: 193031 - RNA, 1701 nt, Artificial Sequence; identical to SEQ ID NO: 192882
  derived and/or modified sequence opt5 from hemagglutinin__InfluenzaA__AGL09748

SEQ ID NO: 193032 - RNA, 1701 nt, Artificial Sequence; identical to SEQ ID NO: 192880
  derived and/or modified sequence opt5 from hemagglutinin__InfluenzaA__AGL09749

SEQ ID NO: 193033 - RNA, 1701 nt, Artificial Sequence; identical to SEQ ID NO: 193018
  derived and/or modified sequence opt5 from hemagglutinin__InfluenzaA__AGL09750

SEQ ID NO: 193034 - RNA, 1701 nt, Artificial Sequence; identical to SEQ ID NO: 192859
  derived and/or modified sequence opt5 from hemagglutinin__InfluenzaA__AGL09751

SEQ ID NO: 193035 - RNA, 1701 nt, Artificial Sequence; identical to SEQ ID NO: 193018
  derived and/or modified sequence opt5 from hemagglutinin__InfluenzaA__AGL09753

SEQ ID NO: 193036 - RNA, 1701 nt, Artificial Sequence
  derived and/or modified sequence opt5 from hemagglutinin__InfluenzaA__AGL09754
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaucagcugccuucugcucuguguggcccugcugggcuucauuaugugggcuugccagaaagggaauauccgcuguaacauuugcaucuga

SEQ ID NO: 193037 - RNA, 1701 nt, Artificial Sequence; identical to SEQ ID NO: 193021
  derived and/or modified sequence opt5 from hemagglutinin__InfluenzaA__AGL09756

SEQ ID NO: 193038 - RNA, 1701 nt, Artificial Sequence
  derived and/or modified sequence opt5 from hemagglutinin__InfluenzaA__AGL09758
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaaaucuguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuauuuggcugguuaaaaaggggaacagcuacccuaaacucucuaauuccuauaucaacgacaagggaaaggaagugcugguccuuuggggcauucaccaccccagcaccacagccgaucaacagucccuguaccagaaugcugacaccuacguguucguggggacgucuagauauagcaaaaaguuuaaaccugagaucgccauucggccgaagguccgcgaucaggagggaagaaugaacuacuauuggacacucguugaacccggcgacaaaaucaccuucgaggcuacagggaaccugguggugccucgguacgccuuugcgauggaacgcaaugccggauccggcauuaucaucagcgauaccaccguccaugacugcaacacaacgugucaaacccccaagggcgcuauuaauacaucucugccuuuccagaacauccaccccauuaccaucgggaaaugcccgaaguaugugaaguccacaaaacucagacuggccaccggacuucggaauguuccuagcauucagucucgcggccuguuuggggcuaucgccggauucaucgagggcggguggacgggaaugguggacggcugguacggcuaucaucaccagaacgaacaagggagcggauacgccgcugaucucaaguccacacagaaugcgauugacaaaaucaccaacaaggucaauucugugauugagaaaaugaacacccaguuuacagccguuggcaaggaguucaaucaccuggaaaagagaaucgagaaccuuaauaaaaagguggaugacggguuccuggauauuuggaccuacaacgcugaacuccugguccugcucgagaaugaacggacacuggacuaucaugauagcaacgugaaaaaccuuuacgagaagguccgcaaucagcugaaaaacaaugccaaggagaucggaaacggcuguuuugaguucuaucacaagugcgacaauauguguauggaguccgugaaaaacgggacguacgauuaucccaaguacagcgaagaggccaaacucaauagagaaaagaucgacggcguuaaacuggagucuacccggauuuaucaaauccuugcuauuuacuccacaguggccagcucucugguccucgugguuucccugggagcgaucagcuuuuggaugugcuccaacggcucucugcagugccgcauuuguaucuga

SEQ ID NO: 193039 - RNA, 1701 nt, Artificial Sequence
  derived and/or modified sequence opt5 from hemagglutinin__InfluenzaA__AGL09760
augaagaccaucauugccgugagcuacauccugugccucgucuucgcucaggagcugcccggcaacgacgauuccacagccacgcuuugucuggggcaccaugcgguuccuaauggaaccauugugaaaacaaucaccaacgaccaaauugaagugacaaaugcuaccgagcucguccagucuagcuccacaggcgaaaucugcaacucuccgcaccagauccuggauggggagaauuguacccuuauugacgcccugcucggagauccccagugcgacggcuuucaaaacaagaaaugggaucuguucguggaaagaagcaaggcccauuccaauuguuauccuuacgacguucccgauuaugcuucucugcggagccucguggccuccagcgggacgcuggaguuuaacaaugagucuuucaacuggaccggagucacacagaauggcaccuccagcgcuugcauccgcagaucuaacaauuccuuuuucagccggcuuaacuggcugacacaccucaauuuuaaauacccugcccugaacgugaccaugcccaacaaugaacaguucgacaaacuuuauauuuggggcguucaucacccugggacggauaaggaccagaucuuucuguacgcgcaagccucuggacgcauuacaguguccaccaagagaagccagcaggcugucaucccgaacauuggcucccggccccgcgugagaaauaucccuucucgggugagcaucuauuggacaauugucaagcccggggauauccuccugauuaacuccaccggaaaucugaucgccccucgcggcuacuucaaaauuagaagcgggaagucuuccaucaugcggagcgacgcucccaucggaaaauguaacucugccugcauuaccccgaauggcagcaucccuaacgacaagcccuuucagaauguuaaccgcauuacauacggcgcguguccuagauaugugaagcaaaauacgcucaaacuggccaccgggaugcggaacgugcccgagaagcagacacgcggaaucuucggcgcuauugccggguuuaucgaaaauggaugggagggcauggucgaugggugguacggauucagacaccagaacuccgagggccggggccaagcugccgaccuuaaaucuacccaggccgcuaucgaucagauuaaugggaagcugaacagacucaucggaaaaacaaacgaaaaguuccaucagauugagaaagaauuuagcgagguggaaggccgcauccaagaccuggagaaguauguugaggauaccaagauugaccuuugguccuacaaugcggaacugcucguggcccuggagaaccagcacacgaucgaucugacagacagcgaaaugaauaaacucuucgagaagaccaaaaagcagcugcgggaaaacgcugaggauauggggaauggaugcuuuaaaauuuaucauaagugugacaacgccugcaucggcucuaucagaaaugggaccuacgaucacgacgucuaucgcgacgaggcccuuaacaaucgguuccagauuaagggcguggaacugaaauccggauacaaggauuggauccucuggauuagcuuugcuaucucuugcuuccugcuuuguguugcccugcucggcuuuauuaugugggcgugccaaaaagggaacaucagauguaauaucugcauuuga

SEQ ID NO: 193040 - RNA, 1701 nt, Artificial Sequence; identical to SEQ ID NO: 192892
  derived and/or modified sequence opt5 from hemagglutinin__InfluenzaA__AGL09761

SEQ ID NO: 193041 - RNA, 1701 nt, Artificial Sequence
  derived and/or modified sequence opt5 from hemagglutinin__InfluenzaA__AGL09762
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcggcagcaauucuuccuuuuucagcagacugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcaaucuuccggccggaucacgguuagcacaaagcgcucccagcaggccgugauuccgaacaucgggucuagaccccggauccgcaauauuccuagcagaaucuccauuuacuggaccaucgucaaacccggagauauucugcugaucaacagcacaggcaaucucaucgcuccucggggguacuucaagauucgcucuggaaaauccagcaucaugagaucugacgcccccauuggcaaguguaagagcgaaugcaucaccccgaacggcuccauuccuaaugacaaacccuuucagaacgugaaucggaucaccuauggggcuuguccucgcuacgugaagcaaucuacacugaaacuugccacgggaaugagaaacguccccgagaagcagacccggggcaucuucggggcgauugccggauuuaucgaaaauggcugggaggggaugguugauggaugguauggcuuccgccaccagaacagcgagggcagagggcaagcugccgaccugaaauccacacaggcugccauugaucagaucaauggaaagcucaaccggcugauuggcaaaaccaaugaaaaguuccaccagaucgagaaggaauuuagcgagguggaagggcgcauucaagaccuugagaaauacguggaggauacaaagaucgaccuguggucuuauaacgccgaacuccuggucgcucuggagaaccagcauaccaucgaucucacggacuccgaaaugaauaaacuguucgagaagaccaaaaagcagcuuagagaaaacgcggaggauaugggaaauggcugcuuuaagauuuaccacaaaugugacaacgccugcaucgggagcauucggaauggcacauaugaucaugacguguacagagacgaggcucugaacaaucgcuuccagaucaagggaguugaacucaaaucuggcuacaaggauuggauucuguggaucuccuuugccaucagcugcuuccuucuguguguggcccuccugggguuuauuaugugggcuugccaaaaaggaaacauccgguguaauauuugcaucuga

SEQ ID NO: 193042 - RNA, 1701 nt, Artificial Sequence; identical to SEQ ID NO: 193018
  derived and/or modified sequence opt5 from hemagglutinin__InfluenzaA__AGL09763

SEQ ID NO: 193043 - RNA, 1701 nt, Artificial Sequence
  derived and/or modified sequence opt5 from hemagglutinin__InfluenzaA__AGL09764
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagagaucuaaagccuauagcaacuguuacccuuaugacgugcccgauuacgcuucccugcggucucucguugccagcuccgggacccuggaauuuaauaacgagagcuucaauuggacgggagugacccagaacggcacaucuuccgcuugcauccgcagaagcaauucuuccuuuuucagccggcuuaacuggcugacccaucucaauuuuaaguauccugcccugaacgucacaaugcccaacaaugagcaguucgacaaacuuuacauuuggggcgugcaccauccugggaccgauaaagaccagaucuuucuguaugcgcaaucuuccggacgcauuacgguuagcacaaagagaucccagcaggccgugaucccgaacaucggcucucggccccgcauuagaaauaucccuagccggauuuccaucuacuggaccauugucaaacccggggauauccuccugaucaacagcacaggaaaucugauugcuccucgcggcuacuucaagaucagaucugggaaauccagcauuaugcggucugacgcccccaucggaaaguguaagagcgaaugcauuaccccgaacggcuccaucccuaaugacaaacccuuucagaacgugaaucgcaucaccuauggcgcuuguccuagauacgugaagcaaucuacacucaaacuggccacggggaugcggaacguccccgagaagcagacccgcggaauuuucggcgcgaucgccggguuuauugaaaauggaugggagggcaugguugaugggugguauggauucagacaccagaacagcgagggccggggccaagcugccgaccuuaaauccacacaggcugccaucgaucagauuaaugggaagcugaacagacucaucggaaaaaccaaugaaaaguuccaccagauugagaaggaauuuagcgagguggaaggccgcauccaagaccuggagaaauacguggaggauacaaagaucgaccuuuggucuuauaacgccgaacugcucgucgcucuggagaaccagcauaccauugaucugacggacuccgaaaugaauaaacucuucgagaagacaaagaagcagcugcgggaaaacgcggaggauauggggaauggaugcuuuaagaucuaccacaaaugugacaacgccugcauuggcagcaucagaaaugggaccuaugaucaugacguguaccgcgacgaggcucuuaacaaucgguuccagauuaagggcguugaacugaaaucuggauacaaggauuggauccucuggaucuccuuugccauuagcugcuuccugcuuuguguggcccugcucggcuuuaucaugugggcuugccaaaaagggaacauuagauguaauaucugcauuuga

SEQ ID NO: 193044 - RNA, 1701 nt, Artificial Sequence; identical to SEQ ID NO: 192882
  derived and/or modified sequence opt5 from hemagglutinin__InfluenzaA__AGL09765

SEQ ID NO: 193045 - RNA, 1701 nt, Artificial Sequence
  derived and/or modified sequence opt5 from hemagglutinin__InfluenzaA__AGL09766
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucugucuggaaaauccagcaucaugcgcucugacgcucccauuggcaaguguaagagcgaaugcaucacaccgaacggcuccauuccuaaugacaaacccuuucagaacgugaauagaaucaccuauggggccuguccucgguacgugaagcaaucuacccuuaaacuggcgacaggaaugcgcaacguccccgagaagcagacgagaggcaucuucggggccauugcuggauuuaucgaaaauggcugggaggggaugguugauggaugguauggcuuccggcaccagaacagcgagggccgcgggcaagccgcugaccucaaauccacccaggccgccauugaucagaucaauggaaagcugaacagacuuauuggcaaaacaaaugaaaaguuccaccagaucgagaaggaauuuagcgagguggaagggcggauucaagaccuggagaaauacguggaggauaccaagaucgaccucuggucuuauaacgcugaacugcuggucgcgcucgagaaccagcauacaaucgaucugaccgacuccgaaaugaauaaacuuuucgagaagacgaaaaagcagcugagagaaaacgccgaggauaugggaaauggcugcuuuaagauuuaccacaaaugugacaacgcuugcaucgggagcauucgcaauggcacauaugaucaugacguguaccgggacgaggcccucaacaauagauuccagaucaagggaguugaacugaaaucuggcuacaaggauuggauucuuuggaucuccuuugccaucagcugcuuccugcucuguguggcucugcugggguuuauuaugugggccugccaaaaaggaaacauccgcuguaauauuugcaucuga

SEQ ID NO: 193046 - RNA, 1701 nt, Artificial Sequence
  derived and/or modified sequence opt5 from hemagglutinin__InfluenzaA__AGL09767
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucauaacguguaccgcgacgaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 193047 - RNA, 1701 nt, Artificial Sequence
  derived and/or modified sequence opt5 from hemagglutinin__InfluenzaA__AGL09769
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugauagaaucgaggugacaaacgcuaccgaacucgugcaaaauucuagcaucggcgagauuugcgacuccccgcaccagauccuggauggggaaaacuguacacuuauugacgcccugcucggagauccccagugcgacggcuuucagaauaaaaagugggaucuguucgucgagcggucuaaagccuauagcaacuguuacccuuaugacgugcccgauuacgcuucccugcgcucucucguugccagcuccgggacccuggaauuuaauaacgagagcuucaauuggacgggagugacccaaaacggcacaucuuccgcuugcaucagaggcagcaauucuuccuuuuucagccggcuuaacuggcugacccaucucaauuuuaaguauccugcccugaacgucacaaugcccaacaaugagcaguucgacaaacuuuacauuuggggagugcaccauccugggaccgauaaagaccagaucuuucuguaugcgcagucuuccggccgcauuacgguuagcacaaagagaucccaacaggccgugaucccgaacaucgggucucggccccgcauuagaaauaucccuagccggauuuccaucuacuggaccauugucaaacccggagauauccuccugaucaacagcacaggcaaucugauugcuccucgcggguacuucaagaucagaucuggaaaauccagcauuaugcggucugacgcccccaucggcaaguguaagagcgaaugcauuaccccgaacggcuccaucccuaaugacaaacccuuucagaacgugaaucgcaucaccuauggggcuuguccuagauacgugaagcagucuacacucaaacuggccacgggaaugcggaacguccccgagaagcaaacccgcggcauuuucggggcgaucgccggauuuauugaaaauggcugggaggggaugguugauggaugguauggcuucagacaccagaacagcgagggccgggggcaggcugccgaccuuaaauccacacaagcugccaucgaucagauuaauggaaagcugaacagacucaucggcaaaaccaaugaaaaguuccaccagauugagaaggaauuuagcgagguggaagggcgcauccaggaccuggagaaauacguggaggauacaaagaucgaccuuuggucuuauaacgccgaacugcucgucgcucuggagaaccaacauaccauugaucugacggacuccgaaaugaauaaacucuucgagaagacaaagaagcagcugcgggaaaacgcggaggauaugggaaauggcugcuuuaagaucuaccacaaaugugacaacgccugcauugggagcaucagaaauggcaccuaugaucaugacguguaccgcgacgaggcucuuaacaaucgguuccagauuaagggaguugaacugaaaucuggcuacaaggauuggauccucuggaucuccuuugccauuagcugcuuccugcuuuguguggcccugcucggguuuaucaugugggcuugccagaaaggaaacauuagauguaauaucugcauuuga

SEQ ID NO: 193048 - RNA, 1701 nt, Artificial Sequence; identical to SEQ ID NO: 192882
  derived and/or modified sequence opt5 from hemagglutinin__InfluenzaA__AGL09770

SEQ ID NO: 193049 - RNA, 1701 nt, Artificial Sequence
  derived and/or modified sequence opt5 from hemagglutinin__InfluenzaA__AGL09771
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguggaagggcgcauucaggaccuugagaaauacguggaggauaccaagaucgaccuguggucuuauaacgcugaacuccuggucgcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacaucuaccgcgacgaggcccugaacaaucgguuccagauuaagggaguggaacucaaaucuggcuacaaggauuggauccuguggaucuccuuugccauuagcugcuuccuucuguguguugcucuccugggguuuaucaugugggccugccagaaaggaaacauuagauguaauaucugcauuuga

SEQ ID NO: 193050 - RNA, 1701 nt, Artificial Sequence
  derived and/or modified sequence opt5 from hemagglutinin__InfluenzaA__AGL09772
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaccugaacuuuaaguacccugcccuuaacgucaccaugcccaauaacgagcaguucgauaagcuguauauuuggggcgugcaucacccugggacggacaaagaucagaucuuucucuacgcgcaagccgcuggacgcauuacaguuucuaccaagagaucccagcaggccgugaucccgaauauuggcagccggccccgcgucagaaacaucccuucccgggugucuaucuauuggacaauugugaaacccggggacauccugcugauuaauagcaccggaaaccucaucgcuccucgcggcuacuucaagauuagauccgggaaaagcucuaucaugcgguccgaugcccccaucggaaaguguaauagcgcgugcauuaccccgaacggcucuaucccuaaugacaagcccuuucagaacgucaaucgcauuacauacggcgccuguccuagauauguuaaacaaaacacgcugaaacuugcuaccgggaugcggaaugugcccgaaaaacagacacgcggaaucuucggcgccauugcuggguuuaucgagaacggaugggaaggcaugguggacgggugguacggauucagacaccagaauagcgagggccggggccaagccgccgaucugaaguccacccaggcugcgaucgaccagauuaacgggaaacucaacagacugaucggaaagacaaaugagaaauuccaucagauugaaaaggaguuuucugaagucgagggccgcauccaagaucuugaaaaguauguggaggacaccaaaauugaucuguggagcuacaacgccgagcuccugguugcucuggaaaaucagcacacgaucgaccucacagauuccgagaugaacaagcuguucgaaaagaccaagaaacagcuucgggagaaugccgaagacauggggaacggaugcuuuaagauuuaucauaagugugauaaugccugcaucggcagcaucagaaacgggaccuacgaccacuauguguaccgcgaugaggcucugaauaaccgguuccagauuaaaggcgucgagcucaagucuggauacaaagacuggauccuguggauuuccuuugccacaagcugcuuccuucuguguguggcgcuccugggcuuuaucaugugggcuugccaaaaggggaauauuagauguaacaucugcaucuga

SEQ ID NO: 193051 - RNA, 1701 nt, Artificial Sequence
  derived and/or modified sequence opt5 from hemagglutinin__InfluenzaA__AGL09773
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagcccauuccaacuguuauccuuacgaugugcccgacuaugcuucucuccggagccugguugccuccagcgggacgcuugaauuuaauaacgagucuuucaauuggaccgaggugacacagaacggaaccuccagcgcuugcauccgcagaucuaauaacuccuuuuucagccggcugaauuggcucacacaccugaacuuuaaguacccugcccuuaacgucaccaugcccaauaacgaacaguucgauaagcuguauauuuggggcgugcaucacccuggcacggacaaagaucagaucuuucucuacgcgcaagccgcugggcgcauuacaguuucuaccaagagaucccagcaggccgugaucccgaauauuggaagccggccccgcgucagaaacaucccuucccgggugucuaucuauuggacaauugugaaacccggcgacauccugcugauuaauagcaccgggaaccucaucgcuccucgcggauacuucaagauuagauccggcaaaagcucuaucaugcgguccgaugcccccaucgggaaguguaauagcgcgugcauuaccccgaacggaucuaucccuaaugacaagcccuuucagaacgucaaucgcauuacauacggcgccuguccuagauauguuaaacaaaacacgcugaaacuugcuaccggcaugcggaaugugcccgagaagcagacacgcgggaucuucggagccauugcuggcuuuaucgaaaacgggugggagggaaugguggacggcugguacggguucagacaccagaauagcgagggacggggccaagccgccgaucugaaguccacccaggcugcgaucgaccagauuaacggcaaacucaacagacugaucgggaagacaaaugaaaaauuccaucagauugagaaggaauuuucugaggucgaaggacgcauccaagaucuugagaaguauguggaggacaccaaaauugaucuguggagcuacaacgccgaacuccugguugcucuggagaaucagcacacgaucgaccucacagauuccgaaaugaacaagcuguucgagaaaaccaagaaacagcuucgggaaaaugccgaggacaugggcaacgggugcuuuaagauuuaucauaagugugauaaugccugcaucggaagcaucagaaacggcaccuacgaccacuauguguaccgcgaugaggcucugaauaaccgguuccagauuaaaggggucgaacucaagucuggcuacaaagacuggauccuguggauuuccuuugccacaagcugcuuccuucuguguguggcgcuccugggauuuaucaugugggcuugccaaaagggcaauauuagauguaacaucugcaucuga

SEQ ID NO: 193052 - RNA, 1701 nt, Artificial Sequence; identical to SEQ ID NO: 193050
  derived and/or modified sequence opt5 from hemagglutinin__InfluenzaA__AGL09774

SEQ ID NO: 193053 - RNA, 1701 nt, Artificial Sequence; identical to SEQ ID NO: 192892
  derived and/or modified sequence opt5 from hemagglutinin__InfluenzaA__AGL09775

SEQ ID NO: 193054 - RNA, 1701 nt, Artificial Sequence; identical to SEQ ID NO: 193050
  derived and/or modified sequence opt5 from hemagglutinin__InfluenzaA__AGL09776

SEQ ID NO: 193055 - RNA, 1701 nt, Artificial Sequence; identical to SEQ ID NO: 193050
  derived and/or modified sequence opt5 from hemagglutinin__InfluenzaA__AGL09777

SEQ ID NO: 193056 - RNA, 1701 nt, Artificial Sequence
  derived and/or modified sequence opt5 from hemagglutinin__InfluenzaA__AGL09778
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugauagaaucgagguuacaaacgcuaccgaacuggugcaaaauucuagcaucggcgagauuugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguccccgauuacgcuucccuccgcucucugguggccagcuccgggacccuugaauuuaauaacgagagcuucaauugggcuggaguuacgcaaaacggcaccucuuccgccugcaucagaggcagcaauucuuccuuuuucagccggcugaacuggcucacacaucugaauuuuaaguauccugcgcuuaacgugaccaugcccaacaaugagcaguucgacaagcuguacauuuggggaguccaccauccugggacagauaaagaccagaucuuucucuaugcccagucuuccggccgcauuaccgugagcacgaagagaucccaacaggcuguuaucccgaacaucgggucucggccccgcauuagaaauaucccuagccggauuuccaucuacuggacaauugugaaacccggagauauccugcugaucaacagcaccggcaaucucauugccccucgcggguacuucaagaucagaucuggaaaauccagcauuaugcggucugacgcucccaucggcaaguguaagagcgaaugcauuacaccgaacggcuccaucccuaaugacaaacccuuucagaacgucaaucgcaucaccuauggggccuguccuagauacgugaagcagucuacccugaaacuugcgacaggaaugcggaacgugcccgagaagcaaacgcgcggcauuuucggggccaucgcuggauuuauugaaaauggcugggaggggaugauggauggaugguauggcuucagacaccagaacagcgagggccgggggcaggccgcugaccugaaauccacccaagccgccaucgaucagauuaauggaaagcucaacagacugaucggcaaaacaaaugaaaaguuccaccagauugagaaggaauuuagcgaggucgaagggcgcauccaggaccuugagaaauacguugaggauaccaagaucgaccuguggucuuauaacgcugaacuccugguggcgcuggagaaccaacauacaauugaucucaccgacuccgaaaugaauaaacuguucgagaagacgaaaaagcagcuucgggaaaacgccgaggauaugggaaauggcugcuuuaagaucuaccacaaaugugacaacgcuugcauugggagcaucagaaauggcacauaugaucaugacguguaccgcgacgaggcccugaacaaucgguuccagauuaagggagucgaacucaaaucuggcuacaaggauuggauccuguggaucuccuuugccauuagcugcuuccuucuguguguggcucuccugggguuuaucaugugggccugccagaaaggaaacauuagauguaauaucugcauuuga

SEQ ID NO: 193057 - RNA, 1701 nt, Artificial Sequence
  derived and/or modified sequence opt5 from hemagglutinin__InfluenzaA__AGL09779
augaagaccaucauugcccugagcuacauccucugccugguguucgcucagaaacuucccggcaacaauaacuccacagccacgcugugucucgggcaccaugcggucccuaauggaaccauuguuaagacaaucaccaacgacagaauugaggugacaaaugcuaccgaacuggugcaaaacucuagcaucggcgagaucugcgauuccccgcaccagauucuugacggggaaaauuguacacugaucgaugcccuccugggagacccccagugcgauggcuuucagaacaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaacgucaccaugcccaauaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugaugcucccauuggcaaguguaagagcgaaugcaucacaccgaauggcuccauuccuaacgacaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaacgcugaacuccuggucgcgcuggagaaucaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugauguguaccgcgacgaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 193058 - RNA, 1701 nt, Artificial Sequence
  derived and/or modified sequence opt5 from hemagglutinin__InfluenzaA__AGL09780
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuugacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuucucucuaugcccaguccagcggccgcaucaccguuuccacgaagagaucucaacaggcugugauuccgaauaucgggagccggccccgcaucagaaacauuccuucccggaucagcauuuacuggacaaucgucaaacccggagacauucugcugaucaauucuaccggcaaccucaucgccccucgcggguacuuuaagauuagauccggaaaaagcucuaucaugcggagcgacgcucccauuggcaaguguaaguccgaaugcaucacaccgaauggcucuauuccuaacgauaaacccuuccagaaugugaaccgcaucaccuauggggccuguccuagauacgugaagcagagcacccugaaacuugcgacaggaaugcggaauguccccgagaagcaaacgcgcggcaucuuuggggccauugcuggauucaucgaaaacggcugggaggggaugguugacggaugguauggcuuuagacaccaaaauuccgagggccgggggcaggccgcugaucugaaaagcacccaggccgccauugaccagaucaacggaaagcucaauagacugauuggcaaaacaaacgaaaaguuccaccagaucgagaaggaguucucugaaguggaagggcgcauucaggaucuugagaaauacguggaggacaccaagaucgaucugugguccuauaaugcugaacuccuggucgcgcuggagaaccaacauacaaucgaccucaccgauagcgaaaugaacaaacuguuugagaagacgaaaaagcagcuucgggaaaaugccgaggacaugggaaacggcugcuucaagauuuaccacaaaugugauaaugcuugcaucgggucuauuagaaacggcacauaugaccaugacguguaccgcgaugaggcccugaauaaccgguuucagaucaagggaguugaacucaaauccggcuacaaggacuggauucuguggaucagcuucgccaucuccugcuuucuucuguguguggcucuccugggguucauuaugugggccugccagaaaggaaauaucagauguaacauuugcaucuga

SEQ ID NO: 193059 - RNA, 1701 nt, Artificial Sequence; identical to SEQ ID NO: 193017
  derived and/or modified sequence opt5 from hemagglutinin__InfluenzaA__AGL09781

SEQ ID NO: 193060 - RNA, 1701 nt, Artificial Sequence; identical to SEQ ID NO: 192882
  derived and/or modified sequence opt5 from hemagglutinin__InfluenzaA__AGL09782

SEQ ID NO: 193061 - RNA, 1701 nt, Artificial Sequence
  derived and/or modified sequence opt5 from hemagglutinin__InfluenzaA__AGL09783
augaagaccaucauugcccugagcuacauccucugccugguguucgcucagaaacuucccggcaacgacaauuccacagccacgcugugucucgggcaccaugcggucccuaacggaaccguugugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauuggacgggagucacccaaaacggcacaucuuccgcuugcaucagacggagcaauaacuccuuuuucucucgccugaauuggcucacccaucugaacuuuaaguauccugcccuuaacgugacaaugcccaauaacgagcaguucgacaagcuguacauuuggggcguucaccauccugggaccgauaaagaccagaucuuucucuaugcgcagagcucuggaagaauuacgguguccacaaagcggagccaacaggccgucaucccgaauauuggcucccgccccagaauccggaacaucccuucucgcauuagcaucuacuggaccauugugaaacccggggauauccugcugauuaauuccacaggaaaccucaucgcuccuagaggcuacuucaagauccggagcgggaaaucuuccauuaugcgcagcgacgcccccaucggaaaguguaagucugaaugcauuaccccgaauggcagcaucccuaacgacaaacccuuucagaaugugaacagaauuaccuauggcgcuuguccucgguacgucaagcaguccacacugaaacuugccacggggaugcgcaauguucccgagaagcaaaccagaggaaucuucggcgcgaucgccggguuuauugaaaacggaugggagggcaugguggaugggugguauggauuccggcaccaaaauucugagggcagaggccaggcugccgaccugaaaagcacacaggcugccaucgaucagauuaacgggaagcucaaucgccugaucggaaaaaccaacgaaaaguuccaccagauugagaaggaauuuuccgagguggaaggccggacacagaaccuugagaaauacgucgaggacaccaagaucgaucuguggagcuauaaugccgaacuccugguggcucuggagaaccaacauacgauugaccucacagauucugaaaugaauaaacuguucgagaagaccaaaaagcagcuuagagaaaacgcggaggacauggggaauggaugcuuuaagaucuaccacaaaugugauaacgccugcaucggcuccauucgcaaugggaccuaugaccaugauguuuaccgggacgaggcucugaacaauagauuccagaucaagggcguggaacucaaaagcggauacaaggacuggauucuguggaucucuuuugccauuuccugcuuccuucugugugucgugcuccugggcuuuaucaugugggccugccagaaagggaacauccgcuguaauauuugcaucuga

SEQ ID NO: 193062 - RNA, 1701 nt, Artificial Sequence; identical to SEQ ID NO: 192892
  derived and/or modified sequence opt5 from hemagglutinin__InfluenzaA__AGL09785

SEQ ID NO: 193063 - RNA, 1701 nt, Artificial Sequence
  derived and/or modified sequence opt5 from hemagglutinin__InfluenzaA__AGL09786
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuugacaaugagagcuucaacugggcuggagugacgcaaaauggcaccucuuccgccugcauuagaggcagcaagucuuccuuuuucagccggcugaacuggcucacacaucugaauuuuaaguauccugcgcuuaacgucaccaugcccaauaacgagcaguucgauaaacuguacaucuggggagugcaccauccugggacagacaaggaucagauuucucucuaugcccaguccagcggccgcaucaccguuuccacgaaaagaucucaacaggcugugauuccgaacaucgggagccggccccgcaucagaaauauuccuucccggaucagcauuuacuggacaaucgucaagcccggagacauucugcugaucaacucuaccggcaaucucaucgccccucgcggguacuuuaaaauuagauccggaaagagcucuaucaugcggagcgacgcucccauuggcaaguguaaauccgaaugcaucacaccgaacggcucuauuccuaaugauaagcccuuccagaacgugaaucgcaucaccuauggggccuguccuagauacgugaaacagagcacccugaagcuggcgacaggaaugcggaacguccccgagaaacaaacgcgcggcaucuuuggggccauugcuggauucaucgaaaauggcugggaggggaugguugacggaugguauggcuuuagacaccagaacuccgagggccgggggcaggccgcugaucuuaagagcacccaagccgccauugaccagaucaauggaaaacucaacagacugauuggcaagacaaaugaaaaguuccaccagaucgagaaagaguucucugaaguggaagggcgcauucaggaucuugagaaguacguggaggacaccaaaaucgaucugugguccuauaacgcugaacuccuggucgcgcuggagaaucaacauacaaucgaccucaccgauagcgaaaugaacaagcuguuugagaaaacgaagaagcagcuucgggaaaacgccgaggacaugggaaauggcugcuucaaaauuuaccacaagugugauaacgcuugcaucgggucuauuagaaauggcacauaugaccaugacguguaccgcgaugaggcccugaacaaucgguuucagaucaaaggaguugaacucaaguccggcuacaaagacuggauucuguggaucagcuucgccaucuccugcuuucuucuguguguggcucuccugggguucauuaugugggccugccagaagggaaacaucagauguaauauuugcaucuga

SEQ ID NO: 193064 - RNA, 1701 nt, Artificial Sequence
  derived and/or modified sequence opt5 from hemagglutinin__InfluenzaA__AGL09787
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacugucccaaagcuauauuaacgauaaggggaaggaagugcuuguccuguggggaauccaccaccccuccaccacagccgaccagcagucucucuaccagaaugcugaugccuacguguucgugggcaccagcagauauuccaaaaaguuuaaaccugagauugcuauccggccgaagguccgcgaccaagaggggagaaugaacuacuauuggacgcugguugaacccggagauaaaauuacauucgaggccaccggcaaccugguggugccucgguacgcguuuacaauggaacgcaaugccgggagcggaaucauuaucucugacacccccguccaugauugcaacaccacaugucagacgccugagggcgcuaucaauaccucccuccccuuccagaacauucacccgaucacaauuggcaagugcccuaaauauguuaagagcaccaagcugagacuugccacagggcugcggaaugugcccucuauccagagccgcggacucuuuggcgcuauugccggguucaucgaaggaggcuggaccgggaugguggacggaugguacggcuaucaucaccaaaacgagcagggcuccggguacgccgcugaccugaaaucuacgcagaaugcgaucgauaagauuacaaacaaagucaauagcgugaucgagaagaugaacacccaguuuaccgccguuggaaaagaguucaaucaccuugagaagagaauugaaaaccugaauaagaaaguggacgauggcuuccucgacaucuggacauacaacgcugagcugcugguccuccuggaaaaugagcggacccuugauuaucaugacuccaacgugaagaaccuguacgagaaaguccgcaaucaacucaagaacaaugccaaagaaauugggaacggauguuuugaguucuaucacaagugcgauaauacauguauggaaagcgugaagaacggcacguacgacuauccuaaauacucugaggaagccaagcugaauagagagaaaaucgaugggguuaaacuugaguccacccggaucuaucagauucuggcuaucuacagcacaguggccucuucccucguccuggugguuagccugggcgcgauuuccuuuuggaugugcucuaacggaagccuccagugccgcaucuguauuuga

SEQ ID NO: 193065 - RNA, 1701 nt, Artificial Sequence; identical to SEQ ID NO: 193064
  derived and/or modified sequence opt5 from hemagglutinin__InfluenzaA__AGL09788

SEQ ID NO: 193066 - RNA, 1701 nt, Artificial Sequence; identical to SEQ ID NO: 193064
  derived and/or modified sequence opt5 from hemagglutinin__InfluenzaA__AGL09789

SEQ ID NO: 193067 - RNA, 1701 nt, Artificial Sequence; identical to SEQ ID NO: 193018
  derived and/or modified sequence opt5 from hemagglutinin__InfluenzaA__AGL09790

SEQ ID NO: 193068 - RNA, 1701 nt, Artificial Sequence
  derived and/or modified sequence opt5 from hemagglutinin__InfluenzaA__AGL09791
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacaugacaaugcccaacaaugagcaguucgacaagcuguacaucuggggcguccaccauccugggaccgauaaagaccagauuucucucuaugcgcaguccagcggaagaaucacgguguccacaaagcggucucaacaggccguuauuccgaacaucggcagccgccccagaauccggaauauuccuucccgcaucagcauuuacuggaccaucgugaaacccggggauauucugcugaucaacucuacaggaaaucucaucgcuccuagaggcuacuuuaagauucgguccgggaaaagcucuaucaugcgcagcgacgcccccauuggaaaguguaaguccgaaugcaucaccccgaacggcucuauuccuaaugacaaacccuuccagaacgucaauagaaucaccuauggcgcuuguccucgguacgugaagcagagcacacugaaacuugccacggggaugcgcaacgugcccgagaagcaaaccagaggaaucuuuggcgcgauugccggguucaucgaaaauggaugggagggcauggucgaugggugguauggauuucggcaccagaacuccgagggcagaggccaggcugccgaccugaaaagcacacaagcugccauugaucagaucaaugggaagcucaaccgccugauuggaaaaaccaaugaaaaguuccaccagaucgagaaggaguucucugaaguugaaggccggauucaggaccuugagaaauacguggaggauacaaagaucgaccugugguccuauaacgccgaacuccugguggcucuggagaaccaacauaccaucgaucucacggacagcgaaaugaauaaacuguuugagaagaccaaaaagcagcuuagagaaaacgcggaggauauggggaauggaugcuucaagauuuaccacaaaugugacaacgccugcaucggcucuauucgcaaugggacauaugaucauaacgucuaccgggacgaggcucugaauaacagauuucagaucaagggcguggaacucaaauccggauacaaggacuggauucuguggaucagcuucgccaucuccugcuuucuucuguguguugcccuccugggcuucauuaugugggcuugccagaaagggaauauccgcuguaacauuugcaucuga

SEQ ID NO: 193069 - RNA, 1701 nt, Artificial Sequence; identical to SEQ ID NO: 193018
  derived and/or modified sequence opt5 from hemagglutinin__InfluenzaA__AGL09792

SEQ ID NO: 193070 - RNA, 1701 nt, Artificial Sequence
  derived and/or modified sequence opt5 from hemagglutinin__InfluenzaA__AGL09794
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacacacccauuggcaaguguaagagcgaaugcaucaccccgaacggcuccauuccuaaugacaaacccuuucagaacgugaaucgcaucaccuauggggcuuguccuagauacgugaagcagucuacacugaaacuugccacgggaaugcggaacguccccgagaagcaaacccgcggcaucuucggggcgauugccggauuuaucgaaaauggcugggaggggaugguugauggaugguauggcuucagacaccagaacagcgagggccgggggcaggcugccgaccugaaauccacacaagcugccauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuucgggaaaacgcggaggauaugggaaauggcugcuuuaagauuuaccacaaaugugacaacgccugcaucgggagcauuagaaauggcacauaugaucaugacguguaccgcgacgaggcucugaacaaucgguuccagaucaagggaguugaacucaaaucuggcuacaaggauuggauucuguggaucuccuuugccaucagcugcuuccuucuguguguggcccuccugggguuuauuaugugggcuugccagaaaggaaacaucagauguaauauuugcaucuga

SEQ ID NO: 193071 - RNA, 1701 nt, Artificial Sequence; identical to SEQ ID NO: 193018
  derived and/or modified sequence opt5 from hemagglutinin__InfluenzaA__AGL09795

SEQ ID NO: 193072 - RNA, 1701 nt, Artificial Sequence
  derived and/or modified sequence opt5 from hemagglutinin__InfluenzaA__AGL09797
augaagaccaucauugcccugagcuacauccucugccugguguucucccagaaacuucccggcaacgacaauucuacagcuacgcugugucucgggcaccaugccgucccuaacggaaccauuguuaagacaaucaccaaugauagaauugaggugacaaacgcgaccgaacuggugcaaaauagcuccaucggcgagaucugcgacucuccgcaccagauucuugauggggaaaacuguacacugaucgacgcucuccugggagauccccagugcgacggcuuucagaauaaaaagugggaucuguucgucgagcggagcaaagccuauuccaacuguuacccuuaugacgugcccgauuacgccucucuccgcagccugguugcuuccagcgggacccuugaauuuaauaacgagucuuucaauugggccggagugacgcaaaacggcaccuccagcgcuugcauuagaggcucuaauuccagcuuuuucucucggcugaacuggcucacacaucugaauuuuaaguauccugcccuuaacgucaccaugcccaacaaugagcaguucgacaagcuguacaucuggggagugcaccauccugggacagauaaagaccagauuuuucucuaugcgcaguccagcggccgcaucaccguuuccacgaagagaucucaacaggccgugauuccgaacaucgggagccggccccgcaucagaaauauuccuucccggaucagcauuuacuggacaaucgucaaacccggagauauucugcugaucaacucuaccggcaaucucaucgcuccucgcggguacuucaagauuagauccggaaaaagcucuaucaugcggagcgacgcccccauuggcaaguguaaguccgaaugcaucacaccgaacggcucuauuccuaaugacaaacccuuucagaacgugaaucgcaucaccuauggggcuuguccuagauacgugaagcagagcacccugaaacuugccacaggaaugcggaacguccccgagaagcaaacgcgcggcaucuucggggcgauugccggauuuaucgaaaauggcugggaggggaugguugauggaugguauggcuucagacaccagaacuccgagggccgggggcaggcugccgaccugaaaagcacccaagcugccauugaucagaucaauggaaagcucaacagacugauuggcaaaacaaaugaaaaguuccaccagaucgagaaggaauuuucugagguggaagggcgcauucaggaccuugagaaauacguggaggauaccaagaucgaccugugguccuauaacgccgaacuccuggucgcucuggagaaccaacauacaaucgaucucaccgacagcgaaaugaauaaacuguucgagaagacgaaaaagcagcuucgggaaaacgcggaggauaugggaaauggcugcuuuaagauuuaccacaaaugugacaacgccugcaucgggucuauuagaaauggcacauaugaucaugacguguaccgcgacgaggcucugaacaaucgguuccagaucaagggaguugaacucaaauccggcuacaaggauuggauucuguggaucagcuuugccaucuccugcuuccuucuguguguggcccuccugggguuuauuaugugggcuugccagaaaggaaacaucagauguaauauuugcaucuga

SEQ ID NO: 193073 - RNA, 1701 nt, Artificial Sequence
  derived and/or modified sequence opt5 from hemagglutinin__InfluenzaA__AGL09798
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacuucgagggccgggggcaggccgcugaccugaaaagcacccaagccgccauugaucagaucaauggaaagcucaacagacugauuggcaaaacaaaugaaaaguuucaccagaucgagaaggaguucuccgaaguggaagggcgcauucaggaccuugagaaauacguggaggauaccaagaucgaccuguggagcuauaacgcugaacuccuggucgcgcuggagaaccaacauacaaucgaucucaccgacucugaaaugaauaaacuguuugagaagacgaaaaagcagcuucgggaaaacgccgaggauaugggaaauggcugcuucaagauuuaccacaaaugugacaacgcuugcaucggguccauuagaaauggcacauaugaucauuacguguaccgcgacgaggcccugaacaaucgguuucagaucaagggaguugaacucaaaagcggcuauaaggacuggauucuguggaucucuuucgccaucuccugcuuucuucuguguguggcucuccugggguucauuaugugggccugccagaaaggaaacaucagauguaauauuugcaucuga

SEQ ID NO: 193074 - RNA, 1701 nt, Artificial Sequence; identical to SEQ ID NO: 193072
  derived and/or modified sequence opt5 from hemagglutinin__InfluenzaA__AGL09799

SEQ ID NO: 193075 - RNA, 1701 nt, Artificial Sequence; identical to SEQ ID NO: 193018
  derived and/or modified sequence opt5 from hemagglutinin__InfluenzaA__AGL09800

SEQ ID NO: 193076 - RNA, 1701 nt, Artificial Sequence; identical to SEQ ID NO: 192882
  derived and/or modified sequence opt5 from hemagglutinin__InfluenzaA__AGL09801

SEQ ID NO: 193077 - RNA, 1701 nt, Artificial Sequence; identical to SEQ ID NO: 192882
  derived and/or modified sequence opt5 from hemagglutinin__InfluenzaA__AGL09802

SEQ ID NO: 193078 - RNA, 1701 nt, Artificial Sequence
  derived and/or modified sequence opt5 from hemagglutinin__InfluenzaA__AGL09803
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagcgcacacugaaacuugccacggggaugagaaacguccccgagaagcaaacccggggaaucuucggcgcgauugccggguuuaucgaaaauggaugggagggcaugguugaugggugguauggauucagacaccagaacucugagggccgcggccaggcugccgaccugaaaagcacacaagcugccauugaucagaucaaugggaagcucaaccggcugauuggaaaaaccaaugaaaaguuccaccagaucgagaaggaauuuuccgagguggaaggccgcauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauauggggaauggaugcuuuaagauuuaccacaaaugugacaacgccugcaucggcuccauucggaaugggacauaugaucaugacguguacagagacgaggcucugaacaaucgcuuccagaucaagggcguugaacucaaaagcggauacaaggauuggauucuguggaucucuuuugccaucuccugcuuccuucuguguguggcccuccugggcuuuauuaugugggcuugccagaaagggaacauccgguguaauauuugcaucuga

SEQ ID NO: 193079 - RNA, 1701 nt, Artificial Sequence; identical to SEQ ID NO: 192915
  derived and/or modified sequence opt5 from hemagglutinin__InfluenzaA__AGL09804

SEQ ID NO: 193080 - RNA, 1701 nt, Artificial Sequence; identical to SEQ ID NO: 193021
  derived and/or modified sequence opt5 from hemagglutinin__InfluenzaA__AGL09805

SEQ ID NO: 193081 - RNA, 1701 nt, Artificial Sequence; identical to SEQ ID NO: 193050
  derived and/or modified sequence opt5 from hemagglutinin__InfluenzaA__AGL09806

SEQ ID NO: 193082 - RNA, 1701 nt, Artificial Sequence; identical to SEQ ID NO: 193021
  derived and/or modified sequence opt5 from hemagglutinin__InfluenzaA__AGL09807

SEQ ID NO: 193083 - RNA, 1701 nt, Artificial Sequence
  derived and/or modified sequence opt5 from hemagglutinin__InfluenzaA__AGL09808
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacgucgggucuagaccccggauccgcaauaucccuagcagaauuuccaucuacuggacaauugugaaacccggagauauccugcugauuaacagcaccggcaaucucaucgccccucggggguacuucaagauccgcucuggaaaauccagcauuaugagaucugacgcucccaucggcaaguguaagagcgaaugcauuacaccgaacggcuccaucccuaaugacaaacccuuucagaacgugaaucggauuaccuauggggccuguccucgcuacgucaagcaaucuacccugaaacuugcgacaggaaugagaaacguucccgagaagcagacgcggggcaucuucggggccaucgcuggauuuauugaaaauggcugggaggggaugguggauggaugguauggcuuccgccaccagaacagcgagggcagagggcaagccgcugaccugaaauccacccaggccgccaucgaucagauuaauggaaagcucaaccggcugaucggcaaaacaaaugaaaaguuccaccagauugagaaggaauuuagcgagguggaagggagaauccaagaccuugagaaauacgucgaggauaccaagauugaccuguggucuuauaacgcugaacuccugguggcgcuggagaaccagcauacaaucgaucucaccgacuccgaaaugaauaaacuguucgagaagacgaaaaagcagcuucgcgaaaacgccgaggauaugggaaauggcugcuuuaagaucuaccacaaaugugacaacgcuugcauugggagcauccggaauggcacauaugaucaugacguuuacagagacgaggcccugaacaaucgcuuccagauuaagggaguggaacucaaaucuggcuacaaggauuggauccuguggauuuccuuugccaucagcugcuuccuucugugugucgcucuccugggguuuaucaugugggccugccaaaaaggaaacauucgguguaauaucugcauuuga

SEQ ID NO: 193084 - RNA, 1701 nt, Artificial Sequence
  derived and/or modified sequence opt5 from hemagglutinin__InfluenzaA__AGL09809
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccggcucugacaacgggacgugcuauccgggagauuuuauugacuacgaggagcuccgggagcagcugagcuccgucagcucuuucgaacgcuuugagaucuuccccaagaccuccagcuggccuaaucacgauucuaacaagggcgugacagccgcuuguccccaugccggcgcgaaaggguuuuauaagaaucuuaucuggcugguuaaaaagggaaacuccuacccuaaacucagcauuucuuauaucaaugacaagggcaaggaagugcugguccuuugggggauucaccaccccuccaccacagccgaucaacagagccuguaccagaacgcugacaccuacguguucgugggaacguccagauauucuaaaaaguuuaaaccugagaucgccauucggccgaagguccgcgaucaggagggcagaaugaauuacuauuggacacucguugaacccggggacaaaaucaccuucgaggcuacaggaaaccugguggugccucgguacgccuuugcgauggaacgcaacgccggcagcggcauuaucaucuccgauacccccguccaugacugcaauaccacaugucaaacgccuaagggggcuauuaacaccagccugcccuuccagaauauccacccgauuacaaucggaaaaugcccuaaguaugugaagucuaccaaacucagacuggccacaggccuucggaacguucccuccauucagagccgcgggcuguuuggagcuaucgccggcuucaucgaagggggauggaccggcaugguggacggcugguacggguaucaucaccagaaugaacaaggaucuggcuacgccgcugaucucaagagcacgcagaacgcgauugacaaaaucacaaauaaggucaacuccgugauugagaaaaugaauacccaguuuaccgccguugggaaggaguucaaccaccuggaaaagagaaucgagaaucuuaacaaaaagguggaugacggauuccuggauauuuggacauacaaugcugaacuccugguccugcucgagaacgaacggacccuggacuaucaugauucuaaugugaaaaaccuuuacgagaagguccgcaaccagcugaaaaauaacgccaaggagaucggcaauggguguuuugaguucuaucacaagugcgacaacacauguauggaaagcgugaaaaauggcacguacgauuauccuaaguacuccgaagaggccaaacucaacagagaagagaucgacggaguuaagcuggagagcacccggauuuaucaaauccuugcuauuuacucuacagccgcguccagccuggugcucgucgugucucugggcgcuaucuccuuuuggaugugcagcaaugggucccugcagugccgcauuuguaucuga

SEQ ID NO: 193085 - RNA, 1701 nt, Artificial Sequence
  derived and/or modified sequence opt5 from hemagglutinin__InfluenzaA__AGL09810
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuagcaaugagucuuucaacuggacgggagugacccaaaauggcacauccagcgcuugcauuagacggucuaacuccagcuuuuucucucgccugaauuggcucacccaucugaacuuuaaguauccugcccuuaaugucacaaugcccaacaacgagcaguucgacaagcuguacaucuggggcgugcaccauccugggaccgauaaagaccagauuuuucucuaugcgcaguccagcggaagaaucacgguuuccacaaagcggucucaacaggccgugauuccgaauaucggcagccgccccagaauccggaacauuccuucccgcaucagcauuuacuggaccaucgucaaacccggggauauucugcugaucaauucuacaggaaaccucaucgcuccuagaggcuacuucaagauucgguccgggaaaagcucuaucaugcgcagcgacgcccccauuggaaaguguaaguccgaaugcaucaccccgaauggcucuauuccuaacgacaaacccuuucagaaugugaacagaaucaccuauggcacauguccucgguacgugaagcagagcacgcugaaacuugcuaccgggaugcgcaauguccccgagaagcaaacaagaggaaucuucggcgccauugcgggguuuaucgaaaacggaugggagggcaugguugaugggugguauggauuccggcaccaaaauuccgagggcagaggccaggccgcugaccugaaaagcacccaggccgcuauugaucagaucaacgggaagcucaaucgccugauuggaaaaacaaacgaaaaguuccaccagaucgagaaggaauuuucugagguggaaggccggauucaggaccuugagaaauacguggaggauaccaagaucgaccugugguccuauaaugccgaacuccuggucgcccuggagaaccaacauacgaucgaucucacagacagcgaaaugaacaaacuguucgagaagaccaaaaagcagcuuagagaaaaugcugaggauauggggaacggaugcuuuaagauuuaccacaaaugugacaaugcgugcaugggcucuauccgcaacgggaccuaugaucaugacguguaccgggacgaggcccugaauaacagauuccagauuaagggcguugaacucaaauccggauacaaggauuggauccuguggauuagcuuugcuaucuccugcuuccuucuguguguggcccuccugggcuuuaucaugugggccugccagaaagggaauauucgcuguaacaucugcauuuga

SEQ ID NO: 193086 - RNA, 1701 nt, Artificial Sequence; identical to SEQ ID NO: 192882
  derived and/or modified sequence opt5 from hemagglutinin__InfluenzaA__AGL09811

SEQ ID NO: 193087 - RNA, 1701 nt, Artificial Sequence
  derived and/or modified sequence opt5 from hemagglutinin__InfluenzaA__AGL09812
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucaggauaaaaagugggaccuguucgucgagcggucuaaagccuauagcaauuguuacccuuaugaugugcccgacuacgcuucccuccgcucucugguugccagcuccgggacccuugaauuuaacaaugagagcuucaacugggcuggagugacgcaaaauggcaccucuuccgccugcauuagaggcagcaacucuuccuuuuucagccggcugaauuggcucacacaucugaacuuuaaguauccugcgcuuaaugucaccaugcccaacaacgagcaguucgauaagcuguacaucuggggagugcaccauccugggacagacaaagaucagauuuuucucuaugcccagucuuccggccgcaucaccguuagcacgaagagaucccaacaggcugugauuccgaauaucgggucucggccccgcaucagaaacauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaaugcugaacuccuggucgcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacguguaccgcgaugaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 193088 - RNA, 1701 nt, Artificial Sequence; identical to SEQ ID NO: 192859
  derived and/or modified sequence opt5 from hemagglutinin__InfluenzaA__AGL09813

SEQ ID NO: 193089 - RNA, 1701 nt, Artificial Sequence; identical to SEQ ID NO: 192907
  derived and/or modified sequence opt5 from hemagglutinin__InfluenzaA__AGL09814

SEQ ID NO: 193090 - RNA, 1701 nt, Artificial Sequence
  derived and/or modified sequence opt5 from hemagglutinin__InfluenzaA__AGL09815
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggagcauuccuucccgcaucagcauuuacuggaccaucgucaaacccggggauauucugcugaucaauucuacaggaaaccucaucgcuccuagaggcuacuucaagauucgguccgggaaaagcucuaucaugcgcagcgacgcccccauuggaaaguguaaguccgaaugcaucaccccgaauggcucuauuccuaacgacaaacccuuucagaaugugaacagaaucaccuauggcgcuuguccucgguacgugaagcagagcacacugaaacuugccacggggaugcgcaauguccccgagaagcaaaccagaggaaucuucggcgcgauugccggguuuaucgaaaacggaugggagggcaugguugaugggugguauggauuccggcaccaaaauuccgagggcagaggccaggcugccgaccugaaaagcacacaggcugccauugaucagaucaacgggaagcucaaucgccugauuggaaaaaccaacgaaaaguuccaccagaucgagaaggaauuuucugagguggaaggccggauucaggaccuugagaaauacguggaggauacaaagaucgaccugugguccuauaaugccgaacuccuggucgcucuggagaaccaacauaccaucgaucucacggacagcgaaaugaacaaacuguucgagaagaccaaaaagcagcuuagagaaaaugcggaggauauggggaacggaugcuuuaagauuuaccacaaaugugacaaugccugcaucggcucuauucgcaacgggacauaugaucaugacguguaccgggacgaggcucugaauaacagauuccagaucaagggcguugaacucaaauccggauacaaggauuggauucuguggaucagcuuugccaucuccugcuuccuucuguguguggcccuccugggcuuuauuaugugggcuugccagaaagggaauauccgcuguaacauuugcaucuga

SEQ ID NO: 193091 - RNA, 1701 nt, Artificial Sequence; identical to SEQ ID NO: 192907
  derived and/or modified sequence opt5 from hemagglutinin__InfluenzaA__AGL09816

SEQ ID NO: 193092 - RNA, 1701 nt, Artificial Sequence
  derived and/or modified sequence opt5 from hemagglutinin__InfluenzaA__AGL09817
augaagaccaucauugcccugagcuacauccucugccugguguucgcucaggagcuucccggcaacgacgauuccacagccacgcugugucucgggcaccaugcggucccuaauggaaccauuguuaaaacaaucaccaacgaccaaauugaagugacaaaugcuaccgagcuggugcagucuagcuccacaggcgaaaucugcaacucuccgcaccagauccuugauggggagaauuguacccugauugacgcccuccugggagauccccagugcgacggcuuucaaaacaagaaaugggaucuguucgucgaaagaagcaaggcccauuccaauuguuauccuuacgacgugcccgauuaugcuucucuccggagccugguugccuccagcgggacgcuugaguuuaacucugaguccuucaauuggaccggagugacacagaacggcaccagcucugcuugcauccgcagauccaauaacagcuuuuucucucggcugaauuggcucacacaccugaacuuuaaauacccugcccuuaaugucaccaugcccaacaacgaacaguucgacaagcuguauauuuggggcgugcaucacccugggacggauaaggaccagaucuuucucuacgcgcaagccuccggacgcauuacaguuagcaccaaaagaucccagcaggcugugaucccgaauauuggcucucggccccgcgucagaaacaucccuagccggguguccaucuauuggacaauugugaagcccggggauauccugcugauuaauagcaccggaaaccucaucgccccucgcggcuacuucaaaauuagaucugggaaguccagcaucaugcggucugacgcucccaucggaaaauguaauagcgccugcauuaccccgaacggcuccaucccuaaugacaagcccuuucagaacgucaaucgcauuacauacggcgcguguccuagauauguuaagcaaaacacgcugaaacuugccaccgggaugcggaaugugcccgagaagcagacacgcggaaucuucggcgcuauugccggguuuaucgaaaacggaugggagggcaugguggaugggugguacggauucagacaccaaaauucugagggccggggccaggcugccgaccugaaaagcacccaggccgcuaucgaucagauuaacgggaagcucaauagacugaucggaaaaacaaacgaaaaguuccaucagauugagaaagaauuuuccgaggucgaaggccgcauccaagaccuugagaaguauguggaggauaccaagauugaccuguggagcuacaacgcggaacuccugguugcccuggagaaucagcacacgaucgaucucacagacucugaaaugaacaaacuguucgagaagaccaaaaagcagcuucgggaaaaugcugaggauauggggaacggaugcuuuaaaauuuaucauaagugugacaaugccugcaucggcuccaucagaaacgggaccuacgaucacgacguguaucgcgacgaggcccugaauaaccgguuccagauuaagggcgucgaacucaaaagcggauacaaggauuggauccuguggauuucuuuugcuaucuccugcuuccuucuguguguggcccuccugggcuuuauuaugugggcgugccaaaaagggaauaucagauguaacaucugcauuuga

SEQ ID NO: 193093 - RNA, 1701 nt, Artificial Sequence; identical to SEQ ID NO: 192907
  derived and/or modified sequence opt5 from hemagglutinin__InfluenzaA__AGL09818

SEQ ID NO: 193094 - RNA, 1701 nt, Artificial Sequence; identical to SEQ ID NO: 193018
  derived and/or modified sequence opt5 from hemagglutinin__InfluenzaA__AGL09819

SEQ ID NO: 193095 - RNA, 1701 nt, Artificial Sequence
  derived and/or modified sequence opt5 from hemagglutinin__InfluenzaA__AGL09820
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauuggacgggagugacccagaacggcacaucuuccgcuugcauucgcggcagcaauucuuccuuuuucagcagacugaacuggcucacccaucugaauuuuaaguauccugcccuuaacgucacaaugcccaacaaugagcaguucgacaagcuguacaucuggggagugcaccauccugggaccgauaaagaccagauuuuucucuaugcgcaaucuuccggccggaucacgguuagcacaaagcgcucccagcaggccgugauuccgaacaucgggucuagaccccggauccgcaauauuccuagcagaaucuccauuuacuggaccaucgucaaacccggagauauucugcugaucaacagcacaggcaaucucaucgcuccucggggguacuucaagauucgcucuggaaaauccagcaucaugagaucugacgcccccauuggcaaguguaagagcgaaugcaucaccccgaacggcuccauuccuaaugacaaacccuuucagaacgugaaucggaucaccuauggggcuuguccucgcuacgugaagcaaucuacacugaaacuugccacgggaaugagaaacguccccgagaagcagacccggggcaucuucggggcgauugccggauuuaucgaaaauggcugggaggggaugguugauggaugguauggcuuccgccaccagaacagcgagggcagagggcaagcugccgaccugaaauccacacaggcugccauugaucagaucaauggaaagcucaaccggcugauuggcaaaaccaaugaaaaguuccaccagaucgagaaggaauuuagcgagauugaagggagaauccaagaccuugagaaauacguggaggauacaaagaucgaccuguggucuuauaacgccgaacuccugguggcucuggagaaccagcauaccauugaucucacggacuccgaaaugaauaaacuguucgagaagaccaaaaagcagcuucgcgaaaacgcggaggauaugggaaauggcugcuuuaagaucuaccacaaaugugacaacgccugcauugggagcauccggaauggcacauaugaucaugacgucuacagagacgaggcucugaacaaucgcuuccagauuaagggaguggaacucaaaucuggcuacaaggauuggauccuguggaucuccuuugccauuagcugcuuccuucuguguguugcccuccugggguuuaucaugugggcuugccaaaaaggaaacauucgguguaauaucugcauuuga

SEQ ID NO: 193096 - RNA, 1701 nt, Artificial Sequence
  derived and/or modified sequence opt5 from hemagglutinin__InfluenzaA__AGL09821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcauugaacucaaaucuggauacaaggacuggauccuguggaucuccuuugccauuagcugcuuccuucuguguguugcccuccugggcuuuaucaugugggcuugccagaaagggaauauucgcuguaacaucugcauuuga

SEQ ID NO: 193097 - RNA, 1701 nt, Artificial Sequence; identical to SEQ ID NO: 193021
  derived and/or modified sequence opt5 from hemagglutinin__InfluenzaA__AGL09822

SEQ ID NO: 193098 - RNA, 1701 nt, Artificial Sequence; identical to SEQ ID NO: 193064
  derived and/or modified sequence opt5 from hemagglutinin__InfluenzaA__AGL09823

SEQ ID NO: 193099 - RNA, 1701 nt, Artificial Sequence
  derived and/or modified sequence opt5 from hemagglutinin__InfluenzaA__AGL09824
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcaccaagagcuuuuauaaaaaccugaucuggcucguuaaaaagggcaauucuuacccuaaacuguccaagagcuauauuaacgauaaggggaaagaagugcuuguccuguggggaauccaccaccccuccacaaccgcggaccaacagucucucuaccagaaugccgaugcuuacguguucgugggcacgagcagauauuccaagaaauuuaagccugagauugccauccggccgaaaguccgcgaccaggaggggagaaugaacuacuauuggacacugauugaacccggagauaagaucaccuucgaggcuacaggcaaccugguugugccucgguacgccuuugcgauggaacgcaaugccgggagcggaauuaucaucucugacacccccgugcaugauugcaacaccacaugucaaacgccugagggcgcuauuaauaccucccuccccuuccagaacauccacccgauuacaaucggcaaaugcccuaaguaugucaagagcaccaaacugagacuugccacagggcugcggaaugugcccucuauucagagccgcggacucuuuggcgcuaucgccggguucaucgaaggaggcuggaccgggaugguugacggaugguacggcuaucaucaccagaacgagcaaggcuccggguacgccgcugaccugaagucuacgcagaaugcgauugauaaaaucacaaacaaggugaauagcgucauugagaaaaugaacacccaguuuaccgccgugggaaaggaguucaaucaccuugagaagagaaucgaaaaccugaauaaaaagguugacgauggcuuccucgacauuuggacauacaacgcugagcugcuggugcuccuggaaaaugagcggacccuugauuaucaugacuccaacgucaaaaaccuguacgagaaggugcgcaaucagcucaaaaacaaugccaaggaaaucgggaacggauguuuugaguucuaucacaagugcgauaauacauguauggaaagcgucaaaaacggcacguacgacuauccuaaguacucugaggaagccaaacugaauagagagaagaucgauggggugaaacuugaguccacccggauuuaucaaauccuggcuauuuacagcacaguugccucuucccucgugcuggucgugagccugggcgcgaucuccuuuuggaugugcucuaacggaagccuccagugccgcauuuguaucuga

SEQ ID NO: 193100 - RNA, 1701 nt, Artificial Sequence; identical to SEQ ID NO: 193018
  derived and/or modified sequence opt5 from hemagglutinin__InfluenzaA__AGL09825

SEQ ID NO: 193101 - RNA, 1701 nt, Artificial Sequence; identical to SEQ ID NO: 193099
  derived and/or modified sequence opt5 from hemagglutinin__InfluenzaA__AGL09826

SEQ ID NO: 193102 - RNA, 1701 nt, Artificial Sequence; identical to SEQ ID NO: 192892
  derived and/or modified sequence opt5 from hemagglutinin__InfluenzaA__AGL09827

SEQ ID NO: 193103 - RNA, 1701 nt, Artificial Sequence
  derived and/or modified sequence opt5 from hemagglutinin__InfluenzaA__AGL09828
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagagaucuaaagccuauagcaacuguuacccuuaugacgugcccgauuacgcuucccuccggucucugguugccagcuccgggacccuugaauuuaauaacgagagcuucaauugggcuggagugacgcagaacggcaccucuuccgccugcauucgcggcagcaauucuuccuuuuucagcagacugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccaaucuuccggccggaucaccguuagcacgaagcgcucccagcaggcugugauuccgaacaucgggucuagaccccggauccgcaauauuccuagcagaaucuccauuuacuggacaaucgucaaacccggagauauucugcugaucaacagcaccggcaaucucaucgccccucggggguacuucaagauucgcucuggaaaauccagcaucaugagaucugacgcucccauuggcaaguguaagagcgaaugcaucacaccgaacggcuccauuccuaaugacaaacccuuucagaacgugaaucggaucaccuauggggccuguccucgcuacgugaagcaaucuacccugaaacuugcgacaggaaugagaaacguccccgagaagcagacgcggggcaucuucggggccauugcuggauuuaucgaaaauggcugggaggggaugguugauggaugguauggcuaccgccaccagaacagcgagggcagagggcaagccgcugaccugaaauccacccaggccgccauugaucagaucaauggaaagcucaaccggcugauuggcaaaacaaaugaaaaguuccaccagaucgagaaggaguucagcgaaguggaagggcgcauucaagaccuugagaaauauguggaggauaccaagaucgaccuguggucuuacaacgcugaacuccuggucgcgcuggagaaccagcauacaaucgaucucaccgacuccgaaaugaauaaacuguuugagaagacgaaaaagcagcuuagagaaaacgccgaggauaugggaaauggcugcuucaagauuuaucacaaaugugacaacgcuugcaucgggagcauucggaauggcacauacgaucaugacguguacagagacgaggcccugaacaaucgcuuucagaucaagggaguugaacucaaaucuggcuauaaggauuggauucuguggaucuccuucgccaucagcugcuuucuucuguguguggcucuccugggguucauuaugugggccugccaaaaaggaaacauccgguguaauauuugcaucuga

SEQ ID NO: 193104 - RNA, 1701 nt, Artificial Sequence
  derived and/or modified sequence opt5 from hemagglutinin__InfluenzaA__AGL09829
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugguugauggaugguauggcuucagacaccagaacagcgagggccgggggcaggccgcugaccuggaauccacccaagccgccauugaucagaucaauggaaaacucaacagacugauuggcaagacaaaugagaaauuccaccagaucgaaaaggaguuuagcgaaguggaggggcgcauucaggaccuugagaaguacguggaagauaccaaaaucgaccuguggucuuauaacgcugagcuccuggucgcgcuggaaaaccaacauacaaucgaucucaccgacuccgagaugaauaagcuguucgagaaaacgaagaaacagcuucgggaaaacgccgaggauaugggaaauggcugcuuuaagauuuaccacaagugugacaacgcuugcaucgggagcauuagaaauggcacauaugaucaugacguguaccgcgacgaagcccugaacaaucgguuccagaucaaaggaguugagcucaagucuggcuacaaagauuggauucuguggaucuccuuugccaucagcugcuuccuucuguguguggcucuccugggguuuauuaugugggccugccagaagggaaacaucagauguaauauuugcaucuga

SEQ ID NO: 193105 - RNA, 1701 nt, Artificial Sequence; identical to SEQ ID NO: 192907
  derived and/or modified sequence opt5 from hemagglutinin__InfluenzaA__AGL09830

SEQ ID NO: 193106 - RNA, 1701 nt, Artificial Sequence; identical to SEQ ID NO: 193017
  derived and/or modified sequence opt5 from hemagglutinin__InfluenzaA__AGL09831

SEQ ID NO: 193107 - RNA, 1701 nt, Artificial Sequence
  derived and/or modified sequence opt5 from hemagglutinin__InfluenzaA__AGL09832
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccauucuaauuuuaaguauccugcccugaacgucacaaugcccaacaaugagcaguucgacaaacuuuacaucuggggcgugcaccauccugggaccgauaaagaccagauuuuucuguaugcgcaguccagcggaagaaucacgguuuccacaaagcggucucaacaggccgugauuccgaacaucggcagccgccccagaauccggaauauuccuucccgcaucagcauuuacuggaccaucgucaaacccggggauauucuccugaucaacucuacaggaaaucugaucgcuccuagaggcuacuucaagauucgguccgggaaaagcucuaucaugcgcagcgacgcccccauuggaaaguguaaguccgaaugcaucaccccgaacggcucuauuccuaaugacaaacccuuucagaacgugaauagaaucaccuauggcgcuuguccucgguacgugaagcagagcacacucaaacuggccacggggaugcgcaacguccccgagaagcaaaccagaggaaucuucggcgcgauugccggguuuaucgaaaauggaugggagggcaugguugaugggugguauggauuccggcaccagaacuccgagggcagaggccaggcugccgaccuuaaaagcacacaagcugccauugaucagaucaaugggaagcugaaccgccucauuggaaaaaccaaugaaaaguuccaccagaucgagaaggaauuuucugagguggaaggccggauucaggaccuggagaaauacguggaggauacaaagaucgaccuuugguccuauaacgccgaacugcucgucgcucuggagaaccaacauaccaucgaucugacggacagcgaaaugaauaaacucuucgagaagacaaagaagcagcugagagaaaacgcggaggauauggggaauggaugcuuuaagauuuaccacaaaugugacaacgccugcaucggcaccauucgcaaugggaccuaugaucauaacguguaccgggacgaggcucuuaauaacagauuccagaucaagggcguugaacugaaaucuggauacaaggacuggauucucuggaucuccuuugccaucagcugcuuccugcuuuguguggcccugcucggcuuuauuaugugggcuugccagaaagggaauauccgcuguaacauuugcaucuga

SEQ ID NO: 193108 - RNA, 1701 nt, Artificial Sequence; identical to SEQ ID NO: 193018
  derived and/or modified sequence opt5 from hemagglutinin__InfluenzaA__AGL09833

SEQ ID NO: 193109 - RNA, 1701 nt, Artificial Sequence
  derived and/or modified sequence opt5 from hemagglutinin__InfluenzaA__AGL09881
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcgccucuuccgcgugcauuagaggcagcaauucuuccuuuuucagccggcugaacuggcucacccaucugaauuuuaaguauccugcccuuaacgucacaaugcccaacaaugagcaguucgacaagcuguacaucuggggagugcaccauccugggaccgauaaagaccagauuuuucucuaugcucagucuuccggccgcaucacaguuagcaccaagagaucccaacaggccgugauuccgaacaucgggucucggccccgcaucagaaauauuccuagccggaucuccauuuacuggacgaucgucaaacccggagauauucugcugaucaacagcacaggcaaucucaucgcuccucgcggguacuucaagauuagaucuggaaaauccagcaucaugcggucugacgcccccauuggcaaguguaagagcgaaugcaucaccccgaacggcuccauuccuaaugacaaacccuuucagaacgugaaucgcaucacauauggggcguguccuagauacgugaagcagucuacccugaaacuugccaccggaaugcggaacguccccgagaagcaaacacgcggcaucuucggggcuauugccggauuuaucgaaaauggcugggaggggaugguugauggaugguauggcuucagacaccagaacagcgagggccgggggcaggcugccgaccugaaauccacgcaagccgcuauugaucagaucaauggaaagcucaacagacugauuggcaaaaccaaugaaaaguuccaccagaucgagaaggaauuuagcgagguggaagggcgcauucaggaccuugagaaauacguggaggauacaaagaucgaccuguggucuuauaacgcggaacuccuggucgcccuggagaaccaacauaccaucgaucucacagacuccgaaaugaauaaacuguucgagaagaccaaaaagcagcuucgggaaaacgcugaggauaugggaaauggcugcuuuaagauuuaccacaaaugugacaacgccugcaucgggagcauuagaaauggcacguaugaucaugacguguaccgcgacgaggcccugaacaaucgguuccagaucaagggaguugaacucaaaucuggcuacaaggauuggauucuguggaucuccuuugcuaucagcugcuuccuucuguguguggcccuccugggguuuauuaugugggcgugccagaaaggaaacaucagauguaauauuugcaucuga

SEQ ID NO: 193110 - RNA, 1701 nt, Artificial Sequence; identical to SEQ ID NO: 192882
  derived and/or modified sequence opt5 from hemagglutinin__InfluenzaA__AGL09882

SEQ ID NO: 193111 - RNA, 1701 nt, Artificial Sequence; identical to SEQ ID NO: 192859
  derived and/or modified sequence opt5 from hemagglutinin__InfluenzaA__AGL09883

SEQ ID NO: 193112 - RNA, 1701 nt, Artificial Sequence; identical to SEQ ID NO: 192859
  derived and/or modified sequence opt5 from hemagglutinin__InfluenzaA__AGL09884

SEQ ID NO: 193113 - RNA, 1683 nt, Artificial Sequence; identical to SEQ ID NO: 193012
  derived and/or modified sequence opt5 from hemagglutinin__InfluenzaA__AGL44438

SEQ ID NO: 193114 - RNA, 1701 nt, Artificial Sequence
  derived and/or modified sequence opt5 from hemagglutinin__InfluenzaA__AGN69267
augaaggccauccuggugguccuccuguacaccuucacaacgggcaacgcugacacccuuugcauuggguaucacgccaauaacagcacagauaccguugacacagugcuggagaagaaugugaccgucacacauuccgugaaccuccuggaagauagacacaauggaaaacuuuguaagcugcggggcguugcgccccuccaucuggggaagugcaacaucgcuggauggcugcucggcaauccugagugugaacugcuuuuuaccgccucuagcugguccuacauuguggagacgucuaacagcgacaaugggaccugcuauccgggagauuucaucaacuacgaagaacugcgcgagcagcucuccucugucagcuccuuugaaagauucgagauuuuucccaaagccagcucuuggccuaaucacgaaacaaaccggggcgugaccgcugccugucccuaugcuggcgccaauuccuucuaccgcaaccugaucuggcuuguuaagaaggggaauagcuauccuaaacugucuaaguccuacaucaacaacaaagagaaggaggugcucguccuguggggcauucaucaucccccuacaagcaccgaccaacagucucuguaccagaaugcggaugccuauguguuugugggauccagcaaauacuccaagaaguucaaaccggaaaucgcuacgagacccaagguccgggggcaggccggacgcaugaacuauuacuggacacucguugagccuggcgacaccauuacauuugaagcuaccgggaaucugguggugcccagauaugccuucgcgaugaaacggggaucuggcagcggcaucauuaucuccgauaccccuguccacgacugcaacacaacgugucaaacccccaagggggccauuaauacaagccuuccguuucagaacauccacccugugaccaucggagagugccccaaauacguuaagucuacaaaacugcgcauggcuaccggccucagaaauauuccuuccauccagagccgggggcuguucggagccauugcuggcuuuaucgaagggggauggacgggcaugauugauggcugguauggguaccaccaucagaacgagcaaggaucuggcuacgccgccgaccgcaagagcacacagaaugcuaucgaugggaucaccaacaaggucaauuccgugauugagaaaaugaacacccaguucacagcggugggaaaggaguucaaucaccuugagaaaagaaucgaaaaccugaauaagaaaguugacgacggccuccuggauguguggaccuauaacgccgagcugcucguccugcuugaaaacgagcggacacuggacuaccacgauucuaaugugaagaaccucuaugagaagguccgcagccagcugaaaaauaacgcuaaggaaauugggaauggcuguuuugaguucuaccauaaaugcgacgauacguguauggaauccgugaagaacggaaccuaugacuaccccaaauauagcgaggaagccaaacuuaauagagaggagaucgauggcguuaagcuggaaucuacacggauuuaccaaauccucgccaucuacuccaccguggcuagcucucugguccugcucgugucccugggggccauuagcuuuuggaugugcuccaacggaucucuucagugcagaaucuguauuuga

SEQ ID NO: 193115 - RNA, 1701 nt, Artificial Sequence
  derived and/or modified sequence opt5 from hemagglutinin__InfluenzaA__AGN69278
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauagacacaaugggaaacuuuguaagcugcggggaguugcuccccuccaucugggcaagugcaacaucgccggguggcugcucggaaauccugagugugaacugcuuuuuaccgccucuagcugguccuacauuguggagacgucuaacagcgacaaugggaccugcuauccgggcgauuucaucaacuacgaagaacugcgcgagcagcucuccucugucagcuccuuugaaagauucgagauuuuucccaaagcuagcucuuggccuaaucacgaacccaaccggggagugacagccgcuuguccuuaugccggcgccaauuccuucuaccgcaaccugaucuggcuuguuaagaagggcaauagcuaucccaaacugucuaaguccuacaucaacaacaaagagaaggaggugcucguccugugggggauucaucacccuccgaccagcacagaccaacagucucuguaccagaaugcggaugcuuauguguuugugggauccagcaaauacaacaagaaguucaaacccgaaaucgccaccagaccuaagguccggggccaggcugggcgcaugaauuauuacuggacgcucguugagcccggagacacaauuaccuuugaagccacaggcaaccugguggugccuagauaugcguucgccaugaaacggggguccggaucuggcaucauuaucagcgauacccccguccacgacugcaauaccacaugucaaacgccgaagggcgcuauuaacaccucccuuccuuuucagaauauccaucccgugacaaucggggagugcccuaaauacguuaagagcaccaaacugcgcauggccacaggacucagaaacauucccucuauccagucccggggccuguucggggcuauugccggauuuaucgaaggcggguggaccggaaugauugauggcugguauggcuaccaccaucagaaugagcaagggagcggauacgccgcugaccgcaagucuacgcagaacgcgaucgauggcaucacaaauaaggugaacagcgucauugagaaaaugaauacccaguucaccgccguggggaaggaguucaaccaccuugagaaaagaaucgaaaaucugaacaagaaaguugacgacggacuccuggauguguggacauauaacgcugagcugcucguccugcuugaaaaugagcggacccuggacuaccacgauuccaacgugaagaaucucuaugagaagguccgcucucagcugaaaaacaaugccaaggaaauuggcaacggguguuuugaguucuaccauaaaugcgacgauacauguauggaaagcgugaagaauggcacguaugacuaccccaaauauuccgaggaagccaaacuuaacagagaggagaucgauggaguuaagcuggaaagcacccggauuuaccaaauccucgcuaucuacucuacaguggccuccagccugguccugcucgugucucugggcgcgauuuccuuuuggaugugcagcaaugggucccuucagugcagaaucuguauuuga

SEQ ID NO: 193116 - RNA, 1701 nt, Artificial Sequence
  derived and/or modified sequence opt5 from hemagglutinin__InfluenzaA__AGN69302
auggaggccaagcuguucgugcucuuuugcgcuuucaccgcccugaaagcggacacaaucugugucggcuaccacgcuaacaauagcacggauaccguugacacaauucuugaaaagaacgugaccgugacacauuccgucaaucugcucgagaacucucacaaugggaaacugugcagccuuaacggaaagaucccccugcagcucggcaauuguaacguggccggguggauucugggaaauccuaaaugcgaucugcuccugaccgccaacuccuggucuuauaucauugaaacaagcaauuccaaggacggcgcuuguuacccgggggaguuugccgauuaugaggaacuuaaggagcaacugucuaccguuagcuccuucgaaagauuugagaucuuccccaaagcuacgagcuggccuaaccaugacaccacacggggaaccacaguggccugcucucacuccggcgcgaauagcuuuuaccgcaaccuccuguggaucgucaagaaaggcaauucuuaucccaaacuuuccaaaagcuacaccaacaacaaggggaaggaagugcugguuauuuggggagugcaucacccucccacggauucugaccagcagacacucuaucagaauaaccacaccuacgucuccgugggcagcuccaaauacuauaagagauucacaccugagaucguggcccggccgaaaguccgcgagcaagcugggagaaugaauuacuauuggacccugcuggaucagggagacaccauuacauuugaagccacgggcaaccucaucgcucccuggcaugccuucgcgcugaagaaagggucuagcuccggaauuaugaugagcgaugcccagguucacaauuguaccacaaagugccagaccccucauggcgcucuuaaaggcaaccugcccuuucaaaaugugcacccugugacaaucggggagugucccaaguacgucaagucuacccagcuccggauggccacgggacugcgcaacauuccguccauccagagcagaggccuuuucggggcuaucgccggauuuauugaaggcggguggacaggaaugguggacggcugguauggcuaccaccaucagaaugagcaagggucuggauaugccgcugaucagaaaagcacccagaucgcgauugacggcaucuccaacaagguuaauucugugauugaaaagaugaacauccaauucaccagcgucgggaaggaguucaauucccuggagaaacggauggaaaaccucaauaagaagguggacgauggauuucuggacguuuggacauacaacgccgagcugcucauccugcuugaaaacgagcgcacccuggauuuccacgaccucaaugugaaaaaccuguacgaaaaggucaaaagccagcuuagaaauaacgcuaaggagauuggcaaugggugcuuugaguucuaucauaaaugugauaacgaaugcauggagucugugaagaauggcacauacaacuauccuaaguacuccgaagagagcaaacugaaucgggaagagaucgacggagucaagcucgagucuaugggcauucaccagauccuggccauuuauuccacgguggccagcucccugguucuccuggugucucuuggggcuaucagcuuuuggaugugcuccaacggaucucugcagugucgcgucugcaucuga

SEQ ID NO: 193117 - RNA, 1701 nt, Artificial Sequence; identical to SEQ ID NO: 193116
  derived and/or modified sequence opt5 from hemagglutinin__InfluenzaA__AGN69314

SEQ ID NO: 193118 - RNA, 1701 nt, Artificial Sequence; identical to SEQ ID NO: 193116
  derived and/or modified sequence opt5 from hemagglutinin__InfluenzaA__AGN69326

SEQ ID NO: 193119 - RNA, 1701 nt, Artificial Sequence
  derived and/or modified sequence opt5 from hemagglutinin__InfluenzaA__AGN69338
auggaggccaagcuguucgugcucuuuugcgcuuucaccgcccugaaagcggacacaaucugugucggcuaccacgcuaacaauagcacggauaccguugacacaauucuugaaaagaacgugaccgugacacauuccgucaaucugcucgagaacucucacaaugggaaacugugcagccuuaacggaaagaucccccugcagcucggcaauuguaacguggccggguggauucugggaaauccuaaaugcgaucugcuccugaccgccaacuccuggucuuauaucauugaaacaagcaauuccaagaacggcgcuuguuacccgggggaguuugccgacuaugaggaacuuaaggagcaacugucuaccguuagcuccuucgaaagauuugagaucuuccccaaagcuacgagcuggccuaaucaugauaccacacggggaaccacaguggccugcucucacuccggcgcgaacagcuuuuaccgcaaucuccuguggaucgucaagaaaggcaacucuuaucccaaacuuuccaaaagcuacaccaacaauaaggggaaggaagugcugguuauuuggggagugcaucacccucccacggacucugaucagcagacacucuaucagaacaaucacaccuacgucuccgugggcagcuccaaauacuauaagagauucacaccugagaucguggcccggccgaaaguccgcgagcaagcugggagaaugaacuacuauuggacccugcugcaucagggagacaccauuacauuugaagccacgggcaaucucaucgcucccuggcacgccuucgcgcugaacgaggggucuagcuccggaauuaugcggagcgaugcccagguucauaauuguaccacaaagugccagaccccucacggcgcucuuaaaggcaaccugcccuuucaaaaugugcacccugugacaaucggggaaugucccaaguacgucaaaucuacccagcuccgcauggccacgggacugagaaacauuccguccauccagagccggggccuuuucggggcuaucgccggauuuauugagggcggguggacaggaaugguggacggcugguauggcuaccaucaccgcaaugaacaggggucuggauaugccgcugaucaaaagagcacccagaucgcgauugacggcaucuccaacaagguuaauucugugauugagaaaaugaacauccaguucaccagcgucgggaaggagugcaauucccuggaaaagagaauggagaaccucaacaagaaaguggaugacggauuccuggacguuuggacauacaaugccgaacugcucauccugcuugagaacgaacggacccuggauuuucaugaccucaaugugaagaaccuguacgagaaggucaaaagccaacuucgcaauaacgcuaaggagauuggcaauggguguuucgaauuuuaucacaaaugcgauaacgagugcauggaaucugugaagaauggcacauacaacuauccuaaauacuccgaggaaagcaagcugaauagagaggagaucgacggagucaagcucgaaucuaugggcauucaucagauccuggccauuuauuccacgguggccagcucccugguucuccuggugucucuuggggcuaucagcuucuggauguguuccaacggaucucugcagugccgggucuguaucuga

SEQ ID NO: 193120 - RNA, 1701 nt, Artificial Sequence
  derived and/or modified sequence opt5 from hemagglutinin__InfluenzaA__AGO00265
augaaggccagacugcucgugcugcuuugcgcuaucgccgcgaccgacgcugauacaauuuguaucggcuaccacgccaacaauagcacggacaccgucgauacaauucuggagaaaaacguuaccgugacacauuccgugaaucuccuggaagacucucacaacgggaaacuuugccggcugaaaggaaucgccccgcuccagcugggcaaguguaauauugcuggguggauccugggaaacccugagugcgaaagccuccuguccgagcgcucuuggagcuauaucgucgaaacccccaauuccgagaacggcacauguuaccccggggauuucauugacuaugaggaacuuagagagcaacugucuagcgugaccuccuuugaacgguucgagaucuuuccuaaagagacgagcuggcccaagcauaauaccacaaagggaguuaccgccgcuugcucucacgccggcaaauguuccuucuaccgcaaccuccuguggcuuacagaaaaggauggcagcuauccuaaucugaacaauucuuacgugaacaaaaaggggaaagagguccucgugcuguggggaguucaucaccccuccaauauuaaggaccagcagacccuguaucagaaggaaaacgcguacgugagcgucgugucuuccaacuacaauagacgguuuacgccugagaucgccgaacgcccgaaagugagaggccaagcugggcggaugaacuauuacuggacacuccuggagcccggagauaccauuaucuucgaggccaauggcaaccuuauugcuccuugguaugccuuugcgcugagccgcggguucggauccggcaucaucacaucuaaugccagcaugcacgaaugcaacaccaagugucagacaccccagggcgcuauuaauuccagccucccuuuucagaacauccaucccgucaccauuggggagugcccgaaauacguuagaucuacgaagcugcggauggugaccggacuucgcaauaucccuuccauucaaagcagaggccuguucggggccaucgcuggauuuaucgaaggcggguggacaggaaugauugacggcugguauggcuaccaccaucagaacgagcaggggucuggauaugccgccgaucagaaaagcacccaaaaugcuaucaacggcauuacaaauaaggugaacuccgucaucgaaaagaugaauacccaguucacggcgguggggaaggaguuuaacaaccucgagaagcggauggaaaaucugaacaaaaagguugacgauggauuccuggacauuuggacauacaaugccgagcuccuggugcuucuggaaaacgagcgcacccucgacuuccacgauucuaaugucaaaaaccuguacgaaaaggugaaaagccagcuuagaaauaacgcuaaggagaucggcaauggguguuuugaguucuaucacaagugcaacaaugaaugcauggaguccguuaaaaacggcaccuacgacuaucccaaguacagcgaagagucuaaacugaaucgggagaagaucgauggagugaaacucgaauccaugggcgucuaucaaauucuggccaucuacagcacaguggccucuucccugguccuccuggugagccuuggggcuauuuccuuuuggauguguucuaacggaagccugcagugcagaaucuguauuuga

SEQ ID NO: 193121 - RNA, 1701 nt, Artificial Sequence
  derived and/or modified sequence opt5 from hemagglutinin__InfluenzaA__AGO00277
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaauugccccgcugcagcugggcaaauguaauaucgccggguggauucucggaaacccugagugcgaaucccugcuuucuaagcggagcugguccuauaucgcugagacccccaauucugaaaacggcacauguuaccccggggauuucgccgacuaugaggagcugcgcgaacaacucagcuccgucagcucuuuugagagauucgaaaucuuuccuaaggagcgguccuggcccaaucauaacauuaauaucggagugaccgcugccugcagccacgcgggcaaaucuuccuucuacaagaaccugcuuuggcugacggagaaagauggcagcuauccuaaucucaacaagucuuacguuaauaaaaaggaaaaggaggugcugguccuguggggagugcaucaccccuccaacauugaaaaccagaaaacccucuaucgcaaggagaaugccuacguuagcguggucuccucuaacuacaauagacgguuuacaccugaaaucgcugagcgcccgaaagugagagggcaggccggccggaugaacuauuacuggacccugcuugagcccggggacacaauuaucuucgaagcuaauggaaaccugauugccccuugguaugcguuugcccucagccgcggccugggguccggaaucaucaccagcaaugcuucuauggaugagugugacacgaagugccagacaccccaaggcgccauuaacuccagccuuccuuuccagaauauccaccccuuuaccauuggcgaauguccgaaauacgugagaucuacaaagcugcggauggucaccgggcuccgcaacaucccuagcauucaguccagaggacuguucggcgcuaucgccggguuuaucgagggaggcugggccgggaugauugauggaugguauggcuaccaucaccagaaugaacaaggcucuggguaugcugcggaccagaaaagcacccagaacgccaucaauggaauuacaaacaagguuaauuccgugaucgagaagaugaacacgcaguucaccgcugugggcaaagaguuuaacaagcuggaaaaacggauggagaaucucaacaagaaagucgaugacggguuccuggacauuuggacauacaaugccgaacuucuggugcuccuggagaacgaacgcacccuugauuuccaugacagcaauguuaagaaccuguacgagaaggugaaaaaucaacucagaaacaaugccaaggagaucggaaacggcugcuuugaguucuaucacaaauguaauaacgaaugcauggaaucugucaagaaugggacauacgauuaucccaaauacuccgaggagagcaagcugaaccgggaaaagaucgacggcgugaaacuggagucuaugggaguuuaucagauucucgcuaucuacuccaccguggccagcucccugguccuucuggugucucucggcgcgauuagcuuuuggaugugcuccaaugggucucugcaguguagaaucugcauuuga

SEQ ID NO: 193122 - RNA, 1701 nt, Artificial Sequence; identical to SEQ ID NO: 184658
  derived and/or modified sequence opt5 from hemagglutinin__InfluenzaA__AGO00289

SEQ ID NO: 193123 - RNA, 1698 nt, Artificial Sequence
  derived and/or modified sequence opt5 from hemagglutinin__InfluenzaA__AGO00301
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaaaagccccgcugcagcugggcaauuguaacauugccggguggguccucggaaauccugagugcgaaucccugcuuucuaaccggagcugguccuauaucgcugagacccccaauucugaaaacggcacauguuaccccggggauuucgccgacuaugaggagcugcgcgaacaacucagcuccgugagcucuuuugagagauucgaaauuuuuccuaaggagcgguccuggcccaaucauaccacgcgcggaguuaccgcugccugcccucacgcgagaaagagcucuuucuacaaaaaccugguguggcuuacagaggccaauggcuccuaucccaaccugagccggucuuacgucaauaaccaggaaaaggaggugcucguucuguggggcgugcaucacccuuccaacaucgaggaacagcgcgcucuguauagaaaagauaaugccuacgucagcgugguguccucuaacuacaaucggcgcuuuaccccggaaaucgcuaagagacccaaaguccgggaccagagcgggcgcaugaacuauuacuggacacuccuggagccuggagauaccauuaucuucgaggccacgggcaaucuuauugcgcccugguaugccuuugcucuguccagagggccuggaagcggcaucauuacaucuaacgcuccccucgacgaaugugauaccaagugccaaacaccgcagggggccaucaauuccagccugccuuuccagaacauucaccccguuaccaucggagaguguccuaaguacgugcggucuaccaaacuucgcauggugacaggccugagaaauauccccagcguccagucccggggccucuuuggggccauugccggauucaucgaaggcggguggacgggaaugauggacggcugguauggguaccaucaccaaaacgagcagggaucuggcuaugcugcggaucaaaagagcacccagaaugccauuaacggcaucacaaauaaagugaacuccguuauugaaaagaugaauacccaguuuacagcuguggggaaagaguucaacaagcuggagaaaagaauggaaaaccugaauaagaaggucgacgacggauuuauggauaucuggaccuacaacgccgagcuccuggugcuucuggaaaaugagcgcacgcucgacuuccaugauagcaacguuaaaaaucuguacgaaaaggugaaaaaccagcuucggaauaacgccaaggagcugggcaaugggugcuucgaguuuuaucacaaaugugacaacgaaugcauggagucugucaagaauggaacauacgauuaucccaaguacuccgaagagagcaaacucaacagagagaagaucgacggcgugaaacuggaaucuaugggggucuaucgcauucuggcuaucuacuccaccguggccagcucccucguucugcuugugucucugggcgcgauuagcuucuggaugugcuccaauggaucucuccagugucggaucugcauuuga

SEQ ID NO: 193124 - RNA, 1701 nt, Artificial Sequence
  derived and/or modified sequence opt5 from hemagglutinin__InfluenzaA__AGO00313
augaagaccaucauugcccugagcuacaucuucugccaggugcucgcucaaaaccugcccggcaaugacaacuccacagccacgcuuugucuggggcaccaugcggucccuaauggaacccucguuaaaacaauuaccaacgaucagaucgaggugacaaaugcuaccgaacuggugcagucuagcuccacaggcagaauuugcgacucuccgcaccggauccuugaugggaagaacuguacccugaucgacgcccuccugggagauccccauugcgacggcuuucagaaugagaaaugggaucuguucgucgaacgcagcaaggccuuuuccaacuguuauccuuacgacgugcccgauuaugcuucucucagaagccugguugccuccagcgggacgcuugaguucauuaaugaaggauuuaacuggaccggcgugacacaaaauggcgggucuuacgcuugcaaacggggaccugacaacuccuucuuuagccgccugaauuggcucuauaagucugaguccaccuaccccguccugaacgugacaaugccuaauaacgauaacuucgacaaacuuuauaucuggggcguucaccauccgagcaccgauaaagagcagacgaaucuguacgugcaggccucugggagagucacaguguccaccaagcggagccagcaaacaauuauccccaacgugggaucccgcccuugggucagaggccucucuagcgggauuuccaucuacuggaccauuguuaaacccggagacauccugcugaucaauagcaacggcaaucucauugcgccucggggcuauuuuaagauccgcaccgggaaaucuuccauuaugagaagcgacgcccccaucggaacauguucuagcgaaugcauuacgccgaacggcuccaucccuaaugauaagcccuuccagaacgugaauaagaucaccuacggggcuuguccuaaauaugugaagcagaacacacugaaacuugccaccggaaugcggaauguccccgagaagcagacacgcggcauuuuuggggcuaucgccggauucauugaaaacggcugggagggcaugaucgacgggugguacggauuuagacaccaaaauucugagggcaccgggcaggcggccgaucugaaaagcacgcaggcugccauugaccaaaucaacggaaagcucaaucgggugaucgaaaagacaaacgagaaguuccaccagauugaaaaggaguucuccgaaguugagggccgcauccaggaucuggagaaauauguggaagacaccaagauugaucuuuggagcuacaacgcugagcugcucgucgcccuggaaaaucagcauaccaucgaccugacagauucugagaugaacaaacucuuugaaaagaccagacggcaacugagagagaaugccgaggacauggggaacggcugcuucaaaauuuaucacaagugugauaaugcuugcaucggauccauucgcaacggcacauacgaccaugacguguaccgggaugaagcgcuuaauaacagauuucagaucaaggggguugagcugaaaagcggauauaaggacuggauccucuggauuucuuucgccaucuccugcuuucugcuuugugugguccugcucggcuucauuaugugggcuugccagaaagggaauauccgcuguaacauuugcaucuga

SEQ ID NO: 193125 - RNA, 1704 nt, Artificial Sequence; identical to SEQ ID NO: 192121
  derived and/or modified sequence opt5 from hemagglutinin__InfluenzaA__AGO00325

SEQ ID NO: 193126 - RNA, 1698 nt, Artificial Sequence
  derived and/or modified sequence opt5 from hemagglutinin__InfluenzaA__AGO00337
augaaggccaaccugcucgugcugcuuagcgcucuggccgcggcugacgccgauaccaucugcauuggcuaccacgccaauaacuccacagacacggucgauaccguucucgagaaaaaugugacagugacccauucugucaaccugcuugaagacagccacaaugggaagcuguguagacucaaaggaaucgcuccccugcagcugggcaagugcaacauugccggguggcuccugggaaauccugagugugauccgcuucugcccgugcgguccuggucuuauaucguugaaacaccuaacagcgagaauggcauuugcuaccccggggacuucaucgauuaugaagaacuccgcgagcaacuguccucugugagcuccuuugaaagauucgagaucuuuccuaaagaaagcucuuggcccaaccauaauaccaacggagucacagcugccuguucccacgagggcaagagcucuuucuaccggaaucuucuguggcucaccgagaaggaaggcuccuauccuaaacugaagaacagcuacgugaauaaaaaggggaaagagguucuggugcucuggggcauucaucacccgcccaacucuaaggaacagcagaaccuguaucagaaugagaacgcguacgucuccguggugacgagcaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugucccggggcuucgggucuggaaucauuacaagcaacgccuccaugcacgaaugcaauaccaagugucagacgccgcuuggcgcuaucaacagcucucugccuuaccagaauguucaucccgugacaaucggcgagugcccuaaauaugugcgcuccgccaagcucagaauggucaccgggcugcggaacacacccagcauucagucucgcggacuguuuggcgcuaucgccggguucauugaaggaggcuggaccgggaugaucgacggaugguacggcuaucaccaucaaaaugagcagggcagcggguacgccgcugaucagaaauccacccagaacgcgauuaauggaaucacaaacaaggugaacacgguuaucgagaaaaugaauauucaauuuaccgccgugggcaaggaguucaacaagcucgagaaaagaauggaaaaucugaacaagaaagucgacgauggguuucuugacaucuggacauacaaugcugagcugcucgugcugcuugaaaacgagcggacccuggacuuccacgauucuaauguuaagaaccucuaugaaaaagucaagagccagcugaagaauaacgccaaagagauuggaaauggcuguuucgaguuuuaccacaagugcgacaacgaauguauggaguccgugcgcaaugggacauaugauuaccccaaauauagcgaagagucuaagcugaacagagagaaaguggacggcgucaagcucgaauccaugggaaucuaccagauucuggccaucuauagcaccguggcuucuucccuuguucugcucgugagccugggcgccaucuccuucuggaugugcucuaaugggagccugcaaugccggauuuguaucuga

SEQ ID NO: 193127 - RNA, 1698 nt, Artificial Sequence; identical to SEQ ID NO: 186302
  derived and/or modified sequence opt5 from hemagglutinin__InfluenzaA__AGO00349

SEQ ID NO: 193128 - RNA, 1698 nt, Artificial Sequence
  derived and/or modified sequence opt5 from hemagglutinin__InfluenzaA__AGO00373
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccgaccauaacaccaauggagucacagcugccugcucucacgagggcaaguccagcuucuaccggaaccuucuguggcucaccgagaaggaaucuuccuauccuaaacugaagaauagcuacgugaacaaaaagggcaaagagguucuggugcucugggggauucaucacccgcccaauucuaaggaacagcagaaccuguaucagaacgagaaugcguacgucuccguggugacgagcaacuacaaucgcagauuuaccccugaaaucgccgagcggcccaagguccgcgaucaagcuggaagaaugaacuauuacuggacacuucugaaaccuggcgacaccauuaucuucgaggccaaugggaaccucauugcucccauguaugccuuugcgcugucccggggauucggcucugggaucauuacaagcaaugccuccaugcacgaauguaacaccaagugccagacgccgcuuggagcuaucaauagcucucugccuuaccagaacauccaucccguuacaauuggcgaguguccuaaauaugugcgcuccgccaagcucagaauggugaccggccugcggaauauccccagcauucagucucgcgggcuguuuggagcuaucgccggcuucauugaagggggauggacaggcaugaucgaugggugguacggauaucaccaucaaaacgagcagggcagcggcuacgccgcugaccagaaauccacccagaaugcgaucaacgggauuaccaauaaggucaacacagugaucgagaaaaugaacauucaauuuacggccguuggaaaggaguucaauaagcucgagaaaagaauggaaaaccugaauaagaaaguggaugacggcuuucuugacaucuggaccuacaacgcugagcugcucguccugcuugaaaaugagcggacacuggauuuccacgacucuaacaugaagaaucucuaugaaaaaguuaagagccagcugaagaacaaugccaaagagauugggaacggaugcuucgaguuuuaccacaagugugauaaugaaugcauggaguccgugcgcaacggcaccuaugacuaccccaaauauagcgaagagucuaagcugaauagagagaaaguggauggggucaagcucgaauccaugggcaucuaccagauccuggccauuuauagcacaguggcuucuucccuuguccugcucgugagccugggagccaucuccuucuggaugugcucuaacggcagccugcaaugucggauuugcaucuga

SEQ ID NO: 193129 - RNA, 1698 nt, Artificial Sequence
  derived and/or modified sequence opt5 from hemagglutinin__InfluenzaA__AGO00385
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaagaacuccgggagcaacugagcuccgugucuagcuuugaacgcuucgagaucuuuccuaaagaauccagcuggcccgaccauaacaccaauggcgucacagcugccugcucucacgagggcaaguccagcuucuacagaaaccuucuguggcucaccgagaaggaaucuuccuauccuaaacugaagaauagcuacgugaacaaaaaggggaaagagguucuggugcucuggggcauucaucacccgcccaauucuaaggaacagcagaaccuguaucagaacgagaaugcguacgucuccguggugacgagcaacuacaaucggcgcuuuaccccugaaaucgccgagagacccaagguccgggaucaagcuggacgcaugaacuauuacuggacacuucugaaaccuggggacaccauuaucuucgaggccaauggaaaccucauugcucccauguaugccuuugcgcuguccagaggcuucgggucuggaaucauuacaagcaaugccuccaugcacgaauguaacaccaagugccagacgccgcuuggcgcuaucaauagcucucugccuuaccagaacauccaucccguuacaauuggcgaguguccuaaauaugugcgguccgccaagcuccgcauggugaccgggcugagaaauauccccagcauucagucucggggacuguuuggcgcuaucgccggguucauugaaggaggcuggacagggaugaucgauggaugguacggcuaucaccaucaaaacgagcagggcagcggguacgccgcugaccagaaauccacccagaaugcgaucaacggaauuaccaauaaggucaacacagugaucgagaaaaugaacauucaauuuacggccguuggcaaggaguucaauaagcucgagaaacgcauggaaaaccugaauaagaaaguggaugacggguuucuugacaucuggaccuacaacgcugagcugcucguccugcuugaaaaugagagaacacuggauuuccacgacucuaacgugaagaaucucuaugaaaaaguuaagagccagcugaagaacaaugccaaagagauuggaaacggcugcuucgaguuuuaccacaagugugauaaugaaugcauggaguccgugcggaacgggaccuaugacuaccccaaauauagcgaagagucuaagcugaaucgcgagaaagucgauggcgugaagcucgaauccaugggaaucuaccagauccuggccauuuauagcacagucgcuucuucccuugugcugcucguuagccugggcgccaucuccuucuggaugugcucuaacgggagccugcaauguagaauuugcaucuga

SEQ ID NO: 193130 - RNA, 1698 nt, Artificial Sequence
  derived and/or modified sequence opt5 from hemagglutinin__InfluenzaA__AGO00397
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaggaacuccgggagcaacugagcuccgugucuagcuuugaacgcuucgagaucuuuccuaaagaauccagcuggcccgaccauaacaccaauggcgucacagcugccugcucucacgagggcaaguccagcuucuacagaaaccuucuguggcucaccgagaaggaaucuuccuauccuaaacugaagaauagcuacgugaacaaaaaggggaaagagguucuggugcucuggggcauucaucacccgcccaauucuaaggaacagcagaaccuguaucagaacgagaaugcguacgucuccguggugacgagcaacuacaaucggcgcuuuaccccugaaaucgccgagagacccaaggucaaagaucaagcuggacggaugaacuauuacuggacacuucugaagccuggggacaccauuaucuucgaggccaauggaaaccucauugcucccauguaugccuuugcgcugucccgcggcuucgggucuggaaucauuacaagcaaugccuccaugcacgaauguaacaccaaaugccagacgccgcuuggcgcuaucaauagcucucugccuuaccagaacauccaucccguuacaauuggcgaguguccuaaguaugugagauccgccaaacuccggauggugaccgggcugcgcaauauccccagcauucagucuagaggacuguuuggcgcuaucgccggguucauugaaggaggcuggacagggaugaucgauggaugguacggcuaucaccaucaaaacgagcagggcagcggguacgccgcugaccagaaguccacccagaaugcgaucaacggaauuaccaauaaagucaacacagugaucgaaaagaugaacauucaauuuacggccguuggcaaggaguucaauaaacucgagaagcggauggaaaaccugaauaaaaagguggaugacggguuucuugacaucuggaccuacaacgcugagcugcucguccugcuugaaaaugagcgcacacuggauuuccacgacucuaacgugaaaaaucucuaugaaaagguuaagagccagcugaaaaacaaugccaaggagauuggaaacggcugcuucgaguuuuaccacaaaugugauaaugaaugcauggaguccgugagaaacgggaccuaugacuaccccaaguauagcgaagagucuaaacugaaucgggagaaggucgauggcgugaagcucgaauccaugggaaucuaccagauccuggccauuuauagcacagucgcuucuucccuugugcugcucguuagccugggcgccaucuccuucuggaugugcucuaacgggagccugcaaugucgcauuugcaucuga

SEQ ID NO: 193131 - RNA, 1698 nt, Artificial Sequence
  derived and/or modified sequence opt5 from hemagglutinin__InfluenzaA__AGO00409
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaggaacuccgggagcaacugagcuccgugucuagcuuugaacgcuucgagaucuuuccuaaagaauccagcuggcccgaccauaacaccaauggcgucacagcugccugcucucacgagggcaagaacuccuucuacagaaaucuucuguggcucaccgagaagaaaagcucuuauccugaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccggcgcuuuaccccugaaaucgccgagagacccaaggucaaagaucaagcuggacggaugaauuauuacuggacacuucugaagccuggggacaccauuaucuucgaggccaacggaaaucucauugcucccauguaugccuuugcgcugagccgcggcuucggguccggaaucauuacaucuaacgccagcaugcacgaauguaauaccaaaugccagacgccgcuuggcgcuaucaacuccagccugccuuaccagaauauccaucccguuacaauuggcgaguguccuaaguaugugagaucugccaaacuccggauggugaccgggcugcgcaacauccccuccauucagagcagaggacuguuuggcgcuaucgccggguucauugaaggaggcuggacagggaugaucgauggaugguacggcuaucaccaucaaaaugagcagggcucuggguacgccgcugaccaaaagagcacccagaacgcgaucaauggaauuaccaacaaagucaacacagugaucgaaaagaugaauauucaguuuacggccguuggcaaggaguucaacaaacucgagaagcggauggaaaaucugaacaaaaagguggaugacggguuucuugacaucuggaccuacaaugcugagcugcucguccugcuugaaaacgagcgcacacuggauuuccacgacuccaaugugaaaaaccucuaugaaaagguuaagucucagcugaaaaauaacgccaaggagauuggaaauggcugcuucgaguuuuaccacaaaugugauaacgaaugcauggagagcgugagaaaugggaccuaugacuaccccaaguauuccgaagagagcaaacugaaccgggagaaggucgauggcgugaagcucgaaucuaugggaaucuaccagauccuggccauuuauuccacagucgcuagcucucuugugcugcucguuucccugggcgccaucagcuucuggaugugcuccaaugggucucugcaaugucgcauuugcaucuga

SEQ ID NO: 193132 - RNA, 1698 nt, Artificial Sequence
  derived and/or modified sequence opt5 from hemagglutinin__InfluenzaA__AGO00421
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcaaacucaagggaaucgcuccccugcagcugggcaaauguaacauugccggguggcuccugggaaauccuggcugcgauccgcuucugcccguggggagcugguccuauaucguugagacaccuaacucugaaaauggaauuuguuaccccggcgacuucaucgauuaugaggaacucagagagcaacugagcuccgugucuagcuuugagcgguucaagaucuuuccuaaggaauccagcuggcccgaccauaacaccacaggcgucaccgcugccugcucucacgaggggaaaaauuccuucuaccgcaaccuucuguggcucacgaagaaagaaagcucuuauccugagcugaaaaauuccuacgugaacaaaaagagaaaggagguucuggugcucuggggcauucaucacccgcccaauagcaaagaacagcagaaccuguaucagaacgagaaugcguacgucucuguggugaccuccaacuacaaucggcgcuuuacaccugaaaucgccgagagacccaaggucaaaggacaagcugggcggaugaacuauuacuggacccuucugaagccuggagauacaauuaucuucgaagccaauggcaaccucauugcucccauguaugccuuugcgcugagccgcggguucggauccggcaucauuaccucuaaugccagcaugcacgaguguaacacgaaaugccagacaccgcuuggcgcuaucaauuccagccugccuuaccagaacauccaucccguuaccauuggggaguguccuaaguaugugagaucugccaaacuccggauggugacaggacugcgcaauauccccuccauucagagcagaggccuguuuggggcuaucgccggauucauugaaggcggguggaccggaaugaucgacggcugguacggcuaucaccaucaaaacgagcaggggucuggauacgccgcugaucaaaagagcacccagaaugcgaucaacggcauuacaaauaaggucaacacggugaucgaaaagaugaacauucaguuuaccgccguugggaaggaguucaauaaacucgaaaagcggauggagaaccugaauaaaaagguggacgauggauuucuugacaucuggacauacaacgcugagcugcucguccugcuugaaaaugagcgcacccuggacuuccacgauuccaacgugaagaaucucuaugaaaaaguuaagucucagcugaaaaacaaugccaaggagauuggcaacgggugcuucgaauuuuaccacaaaugugacaaugagugcauggagagcgugagaaacggcacauaugauuaccccaaguauuccgaagagagcaagcugaaucgggaaaaagucgacggagugaagcucgagucuaugggcaucuaccagauccuggccauuuauuccaccgucgcuagcucucuugugcugcucguuucccugggggccaucagcuucuggaugugcuccaacggaucucugcaaugucgcauuugcaucuga

SEQ ID NO: 193133 - RNA, 1698 nt, Artificial Sequence
  derived and/or modified sequence opt5 from hemagglutinin__InfluenzaA__AGO00433
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacuggagaacuccuacgugaauaagaaagggaaggaaguucuggugcucuggggcauucaucacccgcccaacagcaaagagcagcagaaccuguaucagaaugaaaacgcguacgucucuguggugacguccaauuacaaccgcagauuuaccccugagaucgccgagcggcccaagguccgcgaccaagcuggaagaaugaauuauuacuggacacuucugaagccuggggauaccauuaucuucgaagccaacggaaaucucauugcucccauguaugccuuugcgcugagccggggcuucggguccggaaucauuacaucuaacgccagcaugcacgaguguaauaccaaaugccagacgccgcuuggcgcuaucaacuccagccugccuuaccagaauauccaucccguuacaauuggcgaauguccuaaguaugugcgcucugccaaacucagaauggugaccgggcugcggaacauccccuccauucagagccgcggacuguuuggcgcuaucgccggguucauugagggaggcuggacagggaugaucgacggaugguacggcuaucaccaucaaaaugaacagggcucuggguacgccgcugaucaaaagagcacccagaacgcgaucaauggaauuaccaacaaagucaacacagugaucgagaagaugaauauucaguuuacggccguuggcaaagaguucaacaagcucgaaaagagaauggagaaucugaacaaaaagguggacgauggguuucuugacaucuggaccuacaaugcugaacugcucguccugcuugagaacgaacggacacuggacuuccacgauuccaaugugaaaaaccucuaugagaagguuaaaucucagcugaagaauaacgccaaggagauuggaaauggcugcuucgaauuuuaccacaaaugugacaacgagugcauggaaagcgugcgcaaugggaccuaugauuaccccaaguauuccgaggagagcaaacugaacagagaaaaggucgacggcgugaaacucgagucuaugggaaucuaccagauccuggccauuuauuccacagucgcuagcucucuugugcugcucguuucccugggcgccaucagcuucuggaugugcuccaaugggucucugcaaugucggauuugcaucuga

SEQ ID NO: 193134 - RNA, 1698 nt, Artificial Sequence
  derived and/or modified sequence opt5 from hemagglutinin__InfluenzaA__AGO00445
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuacgcugaaaaacuccuacgugaauaagaaagggaaggagguucuggugcucuggggcauucaucacccgcccaacagcaaagaacagcagaaccuguaucagaaugagaacgcguacgucucuguggugaccuccaauuacaaccgcagauuuacaccugaaaucgccgagcggcccaagguccgcgaccaagcuggaagaaugaauuauuacuggacccuucugaagccuggggauacaauuaucuucgaggccaacggaaaucucauugcucccauguaugccuuugcgcugagccggggcuucggguccggaaucauuaccucuaacgccagcaugcacgaauguaauacgaaaugccagacaccgcuuggcgcuaucaacuccagccugccuuaccagaauauccaucccguuaccauuggcgaguguccuaaguaugugcgcucugccaaacucagaauggugacagggcugcggaacauccccuccauucagagccgcggacuguuuggcgcuaucgccggguucauugaaggaggcuggaccgggaugaucgacggaugguacggcuaucaccaucaaaaugagcagggcucuggguacgccgcugaucaaaagagcacccagaacgcgaucaauggaauuacaaacaaagucaacacggugaucgaaaagaugaauauucaguuuaccgccguuggcaaagaguucaacaagcucgagaagagaauggaaaaucugaacaaaaagguggacgauggguuucuugacaucuggacauacaaugcugagcugcucguccugcuugaaaacgagcggacccuggacuuccacgauuccaaugugaaaaaccucuaugaaaagguuaaaucucagcugaagaauaacgccaaggagauuggaaauggcugcuucgaguuuuaccacaaaugugacaacgaaugcauggagagcgugcgcaaugggacauaugauuaccccaaguauuccgaagagagcaaacugaacagagagaaggucgacggcgugaaacucgaaucuaugggaaucuaccagauccuggccauuuauuccaccgucgcuagcucucuugugcugcucguuucccugggcgccaucagcuucuggaugugcuccaaugggucucugcaaugucggauuugcaucuga

SEQ ID NO: 193135 - RNA, 1701 nt, Artificial Sequence
  derived and/or modified sequence opt5 from hemagglutinin__InfluenzaA__AGO02696
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaggcuuuuauaagaaucuuaucuggcugguuaaaaaggggaacagcuacccuaaacucucuauuuccuauaucaaugacaagggaaaggaagugcugguccuuuggggcauucaccaccccagcaccacagccgaucaacagucccuguaccagaacgcugacaccuacguguucguggggacgucuagauauagcaaaaaguuuaaaccugagaucgccauucggccgaagguccgcgaucaggagggaagaaugaauuacuauuggacacucguugaacccggcgacaaaaucaccuucgaggcuacagggaaccugguggugccucgguacgccuuugcgauggaacgcaacgccggauccggcauuaucaucagcgauacccccguccaugacugcaauaccacaugucaaacgccuaagggcgcuauuaacaccucucugcccuuccagaauauccacccgauuacaaucgggaaaugcccuaaguaugugaaguccaccaaacucagacuggccacaggacuucggaacguucccagcauucagucucgcggccuguuuggggcuaucgccggauucaucgagggcggguggaccggaaugguggacggcugguacggcuaucaucaccagaaugaacaagggagcggauacgccgcugaucucaaguccacgcagaacgcgauugacaaaaucacaaauaaggucaacucugugauugagaaaaugaauacccaguuuaccgccguuggcaaggaguucaaccaccuggaaaagagaaucgagaaucuuaacaaaaagguggaugacggguuccuggauauuuggacauacaaugcugaacuccugguccugcucgagaacgaacggacccuggacuaucaugauagcaaugugaaaaaccuuuacgagaagguccgcaaccagcugaaaaauaacgccaaggagaucggaaauggcuguuuugaguucuaucacaagugcgacaacacauguauggaguccgugaaaaaugggacguacgauuauccuaaguacagcgaagaggccaaacucaacagagaagagaucgacggcguuaagcuggagucuacccggauuuaucaaauccuugcuauuuacuccacagccgcgagcucucuggugcucgucgugucccugggagcuaucagcuuuuggaugugcuccaauggcucucugcagugccgcauuuguaucuga

SEQ ID NO: 193136 - RNA, 1701 nt, Artificial Sequence; identical to SEQ ID NO: 193064
  derived and/or modified sequence opt5 from hemagglutinin__InfluenzaA__AGO02697

SEQ ID NO: 193137 - RNA, 1701 nt, Artificial Sequence; identical to SEQ ID NO: 192882
  derived and/or modified sequence opt5 from hemagglutinin__InfluenzaA__AGO02698

SEQ ID NO: 193138 - RNA, 1701 nt, Artificial Sequence; identical to SEQ ID NO: 192882
  derived and/or modified sequence opt5 from hemagglutinin__InfluenzaA__AGO02699

SEQ ID NO: 193139 - RNA, 1701 nt, Artificial Sequence
  derived and/or modified sequence opt5 from hemagglutinin__InfluenzaA__AGO02700
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccuucgaacgcuuugagaucuuccccaagaccagcucuuggccuaaccacgacuccaauaagggagugacagccgcuuguccccaagccggcgcgaaaucuuuuuauaagaaccugaucuggcucguuaaaaagggcaauagcuacccuaaacuguccaagagcuauauuaacgauaaggggaaagaagugcuuguccuguggggaauccaucaccccuccaccucugccgaccagcagagccucuaccagaaugcugaugccuacguguucgugggcacauccaaguauagcaaaaaguuuaaaccugagauugcugucagaccgaagguucgggaccaagaggggcgcaugaacuacuauuggacccugguggaacccggagauaaaaucacguucgaggccacaggcaaccugcucgugccuagauacgcguuugccauggaacggaaugcugggucuggaauuaucauuuccgacacccccguccacgauugcaacacaaccugucagaccccuaagggcgccaucaauacaagccugcccuuccagaacauccauccgauuacgaucggcaagugcccuaaauaugugaagucuaccaaacuucgccuggcuacagggcucagaaauguucccagcauucagucccggggacuguuuggcgccaucgccggguucauugagggaggcuggaccgggaugguggacggaugguacggcuaucaccaucaaaacgcucagggcucuggguacgcggccgaccuuaagagcacacagaaugcuaucgauaaaaucaccaacaaggucaauuccgugauugaaaagaugaacacgcaguuuacagccguuggaaaagaguucaaucaccuggagaagcgcaucgaaaaccucaauaaaaagguggacgauggcuuccuggacauuuggaccuacaacgccgagcugcucguccugcuugaaaaugagagaacccuggauuaucacgacagcaacgugaaaaaccucuacgaaaagguccggucucaacugaagaauaacgcuaaagagaucgggaauggauguuuugaguucuaucauaagugcgauaacacauguauggaauccgugaaaaauggcaccuacgacuauccucgcuacagcgaggaagccaaacuuaacagagaggaaauugaugggaucaagcuggagucuacacggaucuaucagauucucgcgaucuacuccacgguugcuagcucccuggugcugauugucucucucggcgccaucagcuuuuggaugugcuccaauggaucucugcagugccgcauuuguaucuga

SEQ ID NO: 193140 - RNA, 1701 nt, Artificial Sequence
  derived and/or modified sequence opt5 from hemagglutinin__InfluenzaA__AGO02701
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucucacuucgaacgcuuugagaucuuccccaagaccuccagcuggccuaaccaugacucuaauaagggagugacagccgcuuguccccacgccggcgcgaaauccuuuuauaagaaccugaucuggcucguuaaaaagggcaauagcuacccuaaacugucuaaguccuauauuaacgauaaggggaaagaagugcuuguccuguggggaauccaccaucccagcaccuccgccgaccaacagucucucuaccagaaugcugaugccuacguguucgugggcacaagcaaguauuccaaaaaguuuaaaccugagauugcugucagaccgaagguucgggaccaggaggggcgcaugaacuacuauuggacccugguggaacccggagauaaaaucacguucgaggccacaggcaaccugcucgugccuagauacgcguuugccauggaacggaaugcugggagcggaauuaucauuucugacacccccguccacgauugcaacacaaccugucaaaccccuaagggcgccaucaauacaucccugcccuuccagaacauccauccgauuacgaucggcaagugcccuaaauauguuaagagcaccaaacuucgccuggcuacagggcucagaaaugugcccucuauucagagccggggacuguuuggcgccaucgccggguucauugagggaggcuggaccgggaugguggacggaugguacggcuaucaccaccagaacggccaaggguccggauacgcugcggaccuuaagucuacacagaaugccaucgauaaaaucaccaacaaggucaauagcgugauugaaaagaugaacacgcaguuuacagcuguuggcaaagaguucaaucaucuggagaagcgcaucgaaaaccucaauaaaaagguggacgauggguuccuggacauuuggaccuacaacgccgagcugcucguccugcuugaaaaugagagaacccuggauuaucacgacuccaacgugaaaaaccucuacgaaaagguccggagccagcugaagaauaacgccaaagagaucggaaauggcuguuuugaguucuaucauaagugcgauaacacauguauggaaucugugaaaaaugggaccuacgacuauccuaaguacuccgaggaagcuaaacuuaaccgcgaggaaauugauggcguuaagcuggagagcacaagaaucuaucaaauccucgccauuuacucuacgguggcguccagccugguccuggugguuucccucggagcuaucucuuuuuggaugugcagcaauggcucccugcagugccggauuuguaucuga

SEQ ID NO: 193141 - RNA, 1683 nt, Artificial Sequence; identical to SEQ ID NO: 193012
  derived and/or modified sequence opt5 from hemagglutinin__InfluenzaA__AGO51374

SEQ ID NO: 193142 - RNA, 1701 nt, Artificial Sequence
  derived and/or modified sequence opt5 from hemagglutinin__InfluenzaA__AGO86686
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagccgccucaacuggcugcaccagcuugagaauagauauccugcccugaacgugaccaugcccaauaacgacaaguuugauaaacucuacaucuggggcguccaucacccuucuacagacuccgaucagauuagcguguaugcucaggccuccgggcggguuaccgugucuacgaagcgcagccaacagacagucaucccgaacauuggauccagacccugggugcggggcaucagcucucgcauuuccaucuacuggaccaucgugaaaccuggggacauucugcugaucaauagcacaggaaaccucauugcucccagaggcuacuucaagauccggucugggaaaagcuccauuaugcgcucugacgccccuaucggaaaguguaauagcgaaugcaucacccccaacggcuccauuccgaaugauaagccuuuucagaacgucaauagaaucaccuauggcgcguguccccgguacguuaaacagaacacacugaaacuugccacggggaugcgcaaugugccugagaaacaaaccagaggaauuuucggcgcuaucgccggguuuauugaaaacggaugggagggcaugauggacgggugguauggauuccggcaccagaauagcgagggcacaggccaggcugccgaucugaagucuacccaagccgcuaucaaccagaucaaugggaaacucaacaagcugauugaaaagacaaaugagaaguuucaucagaucgaaaaggaguucuccgaaguggagggacgcauucaggaccuugagaaauacgucgaagauaccaagaucgaccuguggagcuauaacgcggagcuccugguggcccuggaaaaccaacacacgauugaucucacagacucugagaugaauaaacuguucgaaagaacccggaagcagcuuagagagaacgcugaggauaugggcaaugggugcuuuaaaaccuaccauaagugugacaacgccugcaucggauccauucgcaauggcacauaugaucacgacguuuaccgggacgaagcccugaacaauagauuccagaucaaggggguggagcucaaaagcggcuacaaggauuggauccuguggauuuccuuugcuaucucuugcuuccuucugugugucgugcuccugggauuuauuaugugggccugccagaaaggcaacauccgcuguaauauuugcaucuga

SEQ ID NO: 193143 - RNA, 1701 nt, Artificial Sequence; identical to SEQ ID NO: 193064
  derived and/or modified sequence opt5 from hemagglutinin__InfluenzaA__AGQ16240

SEQ ID NO: 193144 - RNA, 1701 nt, Artificial Sequence; identical to SEQ ID NO: 193064
  derived and/or modified sequence opt5 from hemagglutinin__InfluenzaA__AGQ16241

SEQ ID NO: 193145 - RNA, 1701 nt, Artificial Sequence
  derived and/or modified sequence opt5 from hemagglutinin__InfluenzaA__AGQ16242
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaccagcuauauuaacgauaaggggaaggaaauccuugugcuguggggcauucaccaccccuccacaaccgccgaccaacagucucucuaccagaaugcugaugccuacgucuucgugggaacgagcagauauuccaaaaaguuuaaaccugagaucgcuauucggccgaaggugcgcgaccaggaggggagaaugaacuacuauuggacacuggucgaacccggagauaaaaucaccuucgaggccacaggcaaccugguugugccucgguacgcguuugccauggaacgcaaugcugggagcggaauuaucaucucugacacccccgugcaugauugcaacaccacaugucaaacgccugagggcgccauuaauaccucccuccccuuccagaacauccacccgauuacaaucggcaagugcccuaaauaugucaagagcaccaagcugagacuugcuacagggcugcggaaugugcccucuauucagagccgcggacucuuuggcgccaucgccggguucaucgaaggaggcuggaccgggaugguugacggaugguacggcuaucaucaccagaacgagcaaggcuccggguacgcugcggaccugaaaucuacgcagaaugccauugauaagaucacaaacaaagugaauagcgucauugagaagaugaacacccaguuuaccgcugugggaaaagaguucaaucaccuugagaagagaaucgaaaaccugaauaagaaaguugacgauggcuuccucgacauuuggacauacaacgccgagcugcuggugcuccuggaaaaugagcggacccuugauuaucaugacuccaacgucaagaaccuguacgagaaagugcgcaaucagcucaagaacaaugccaaagaaaucgggaacggauguuuugaguucuaucacaagugcgauaauacauguauggaaagcgucaagaacggcacguacgacuauccuaaauacucugaggaagcuaagcugaauagagagaaaaucgauggggugaaacuugaguccacccggauuuaucaaauccuggccauuuacagcacaguugcgucuucccucgugcuggucgugagccugggcgcuaucuccuuuuggaugugcucuaacggaagccuccagugccgcauuuguaucuga

SEQ ID NO: 193146 - RNA, 1701 nt, Artificial Sequence; identical to SEQ ID NO: 193084
  derived and/or modified sequence opt5 from hemagglutinin__InfluenzaA__AGQ16243

SEQ ID NO: 193147 - RNA, 1701 nt, Artificial Sequence
  derived and/or modified sequence opt5 from hemagglutinin__InfluenzaA__AGQ16245
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaaugaacuacuauuggacgcugauugaacccggagauaagaucacauucgaggccaccggcaaccugguugugccucgguacgcguuugccauggaacgcaaugcugggagcggaauuaucaucucugacacacccgugcaugauugcaacaccaccugucaaacaccugagggcgccauuaauacgucccuccccuuccagaacauccacccgauuaccaucggcaaaugcccuaaguaugucaagagcacaaaacugagacuugcuaccgggcugcggaaugugcccucuauucagagccgcggacucuuuggcgccaucgccggguucaucgaaggaggcuggacagggaugguugacggaugguacggcuaucaucaccagaacgagcaaggcuccggguacgcugcggaccugaagucuacccagaaugccauugauaaaaucacgaacaaggugaauagcgucauugagaaaaugaacacacaguuuaccgcugugggaaaggaguucaaucaccuugagaagagaaucgaaaaccugaauaaaaagguugacgauggcuuccucgacauuuggaccuacaacgccgagcugcuggugcuccuggaaaaugagcggacacuugauuaucaugacuccaacgucaaaaaccuguacgagaaggugcgcaaucagcucaaaaacaaugccaaggaaaucgggaacggauguuuugaguucuaucacaagugcgauaauaccuguauggaaagcgucaaaaacggcacauacgacuauccuaaguacucugaggaagcuaaacugaauagagagaagaucgauggggugaaacuugaguccacgcggauuuaucaaauccuggccauuuacagcaccguugcgucuucccucgugcuggucgugagccugggcgcuaucuccuuuuggaugugcucuaacggaagccuccagugccgcauuuguaucuga

SEQ ID NO: 193148 - RNA, 1701 nt, Artificial Sequence; identical to SEQ ID NO: 193084
  derived and/or modified sequence opt5 from hemagglutinin__InfluenzaA__AGQ16247

SEQ ID NO: 193149 - RNA, 1701 nt, Artificial Sequence
  derived and/or modified sequence opt5 from hemagglutinin__InfluenzaA__AGQ16248
augcaggccauccuggugguccuccuguacaccuucgcuacagccacggcggacacccuuugcauuggcuaucacgcuaacaauagcacagauaccguugacacagugcuggagaagaacgugaccgucacacauuccgugaaucuccuggaagauaaacacaacgggaaacuuuguaagcugagaggaguugcgccccuccaucugggcaagugcaauaucgccggguggauucugggaaacccugagugugaaucucucagcaccgcuuccucuuggagcuacaucguggagacguccucuagcgacaaugggaccugcuauccgggcgauuuuauuaacuacgaagaacugcgggagcaacuuuccagcgucucuuccuucgaacgcuuugagaucuuccccaaaacaagcucuuggccuaaucacgacuccaacaagggagugaccgccgcuuguccccaugccggcgccaagagcuuuuauaaaaaucugaucuggcucguuaagaaaggcaacucuuacccuaagcugucccagagcuauauuaaugauaaagggaaggaagugcuuguccuguggggaauccaccaccccuccacaaccgccgaccagcagucucucuaccaaaacgcugaugccuacguguucgugggcacgagcagauauuccaagaaauuuaagccugagauugcuauccggccgaaaguccgcgaccaggaggggagaaugaauuacuauuggacacugguugaacccggagauaagauuaccuucgaggccacaggcaaccugguggugccucgguacgcguuuaccauggaacgcaacgccgggagcggaaucauuaucucugacacccccauccaugauugcaauacaacgugucagaccccugagggcgcuauuaacacaucccuccccuuccagaauauccacccgauuaccaucggcaaaugcccuaaguaugucaaaagcacaaagcugagacuugccaccgggcugcggaacgugcccucuauucaaagccgcggacucuuuggcgcuaucgccggguucaucgaaggaggcuggacggggaugguugacggaugguacggcuaucaucaccagaaugagcagggcuccggguacgccgcugaccugaagucuacacagaacgcgauugauaaaaucaccaauaaggugaacagcgucauugagaaaaugaauacccaauuuacagccgugggaaaggaguucaaccaccuugagaaaagaaucgaaaaucugaacaagaagguugacgauggcuuccucgacauuuggaccuacaaugcugagcugcuggugcuccuggaaaacgagcggacacuugauuaucaugacuccaaugucaaaaaccuguacgagaaggugcgcaaccagcucaaaaauaacgccaaggaaaucgggaauggauguuuugaguucuaucacaaaugcgauaacacguguauggaaagcgucaagaauggcaccuacgacuauccuaaguacucugaggaagccaaacugaacagagagaagaucgauggggugaaacuugaguccacacggauuuaucagauccuggcuauuuacagcaccguugccucuucccucgugcuggucgugagccugggcgcgaucuccuuuuggaugugcucuaauggaagccuccaaugccgcauuuguaucuga

SEQ ID NO: 193150 - RNA, 1701 nt, Artificial Sequence; identical to SEQ ID NO: 192882
  derived and/or modified sequence opt5 from hemagglutinin__InfluenzaA__AGQ16329

SEQ ID NO: 193151 - RNA, 1701 nt, Artificial Sequence; identical to SEQ ID NO: 192907
  derived and/or modified sequence opt5 from hemagglutinin__InfluenzaA__AGQ16331

SEQ ID NO: 193152 - RNA, 1701 nt, Artificial Sequence; identical to SEQ ID NO: 192882
  derived and/or modified sequence opt5 from hemagglutinin__InfluenzaA__AGQ16332

SEQ ID NO: 193153 - RNA, 1701 nt, Artificial Sequence; identical to SEQ ID NO: 192882
  derived and/or modified sequence opt5 from hemagglutinin__InfluenzaA__AGQ16333

SEQ ID NO: 193154 - RNA, 1701 nt, Artificial Sequence
  derived and/or modified sequence opt5 from hemagglutinin__InfluenzaA__AGQ16335
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagguccuugauggggaaaacuguacacugauugacgcccuccugggagauccccagugcgacggcuuucagaauaaaaagugggaucuguucguggagcggucuaaagccuauagcaacuguuacccuuaugacguucccgauuacgcuucccuccgcucucugguggccagcuccgggacccuugaauuuaauaacgagagcuucaauuggacgggagucacccaaaacggcacaucuuccgcuugcaucagacggagcaauucuuccuuuuucagccgccugaacuggcucacccaucugaauuuuaaguauccugcccuuaacgugacaaugcccaacaaugagcaguucgacaagcuguacauuuggggcguucaccauccugggaccgauaaagaccagaucuuucucuaugcgcagucuuccggaagaauuacggugagcacaaagcggucccaacaggccgucaucccgaacauuggcucucgccccagaauccggaauaucccuagccgcauuuccaucuacuggaccauugugaaacccggggauauccugcugauuaacagcacaggaaaucucaucgcuccuagaggcuacuucaagauccggucugggaaauccagcauuaugcgcucugacgcccccaucggaaaguguaagagcgaaugcauuaccccgaacggcuccaucccuaaugacaaacccuuucagaacgugaauagaauuaccuauggcgcuuguccucgguacgucaagcagaacacacugaaacuugccacggggaugcgcaauguucccgagaagcaaaccagaggaaucuucggcgcgaucgccggguuuauugaaaacggaugggagggcaugguggaugggugguauggauuccggcaccaaaauucugagggcagaggccaggcugccgaccugaaaagcacacaggcugccaucgaucagauuaacgggaagcucaaucgccugaucggaaaaaccaacgaaaaguuccaccagauugagaaggaauuuuccgagguggaaggccggauccaggaccuugagaaauacgucgaggauacaaagauugaccuguggagcuauaacgccgaacuccugguggcucuggagaaucaacauaccaucgaucucacggacucugaaaugaacaaacuguucgagaagaccaaaaagcagcuuagagaaaaugcggaggauauggggaacggaugcuuuaagaucuaccacaaaugugacaaugccugcauuggcuccauccgcaacgggacauaugaucaugacguuuaccgggacgaggcucugaauaacagauuccagauuaagggcguggaacucaaaagcggauacaaggauuggauccuguggauuucuuuugccaucuccugcuuccuucugugugucgcccuccugggcuuuaucaugugggcuugccagaaagggaauauucgcuguaacaucugcauuuga

SEQ ID NO: 193155 - RNA, 1701 nt, Artificial Sequence
  derived and/or modified sequence opt5 from hemagglutinin__InfluenzaA__AGQ16336
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaaucgcuccuuuuucucuagacugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagagcucuggacggaucacgguuuccacaaagcgcagccaacaggccgugauuccgaacaucggcuccagaccccggauccgcaauauuccuucuagaaucagcauuuacuggaccaucgucaaacccggggauauucugcugaucaacuccacaggaaaucucaucgcuccucggggcuacuucaagauucgcagcgggaaaucuuccaucaugagaagcgacgcccccauuggaaaguguaagucugaaugcaucaccccgaacggcagcauuccuaaugacaaacccuuucagaacgugaaucggaucaccuauggcgcuuguccucgcuacgugaagcaguccacacugaaacuugccacggggaugagaaacguccccgagaagcaaacccggggaaucuucggcgcgauugccggguuuaucgaaaauggaugggagggcaugguugaugggugguauggauucagacaccagaacucugagggccgcggccaggcugccgaccugaaaagcacacaagcugccauugaucagaucaaugggaagcucaaccggcugauuggaaaaaccaaugaaaaguuccaccagaucgagaaggaauuuuccgagguggaaggccgcauucaggaccuugagaaauacguggaggauacaaagaucgaccuguggagcuauaacgccgaacuccuggucgcucuggagaaccaacauaccaucgaucucacggacucugaaaugaauaaacuguucgagaagaccaaaaagcagcuuagagaaaacgcggaggauauggggaauggaugcuuuaagauuuaccacaaaugugacaacgccugcaucggcuccauucggaaugggacauaugaucaugacguguacagagacgaggcucugaacaaucgcuuccagaucaagggcguugaacucaaaagcggauacaaggauuggauucuguggaucucuuuugccaucuccugcuuccuucuguguguggcccuccugggcuuuauuaugugggcuugccagaaagggaacauccgguguaauauuugcaucuga

SEQ ID NO: 193156 - RNA, 1701 nt, Artificial Sequence; identical to SEQ ID NO: 193154
  derived and/or modified sequence opt5 from hemagglutinin__InfluenzaA__AGQ16337

SEQ ID NO: 193157 - RNA, 1701 nt, Artificial Sequence; identical to SEQ ID NO: 192892
  derived and/or modified sequence opt5 from hemagglutinin__InfluenzaA__AGQ16338

SEQ ID NO: 193158 - RNA, 1701 nt, Artificial Sequence
  derived and/or modified sequence opt5 from hemagglutinin__InfluenzaA__AGQ16339
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagaaauauuccuagccggaucuccauuuacuggacaaucgucaaacccggagauauucugcugaucaacagcaccggcaaucucaucgccccucgcggguacuucaagauuagaucuggaaaauccagcaucaugcggucugacgcucccauuggcaaguguaagagcgaaugcaucacaccgaacggcuccauuccuaaugacaaacccuuucagaacgugaaucgcaucaccuauggggccuguccuagauacgugaagcagucuacccugaaacuugcgacaggaaugcggaacguccccgagaagcaaacgcgcggcaucuucggggccauugcuggauuuaucgaaaauggcugggaggggaugauggauggaugguauggcuucagacaccagaacagcgagggccgggggcaggccgcugaccugaaauccacccaagccgccauugaucagaucaauggaaagcucaacagacugauuggcaaaacaaaugaaaaguuccaccagaucgagaaggaauuuagcgagguugaagggcgcauucaggaccuugagaaauacguggaggauaccaagaucgaccuguggucuuauaacgcugaacuccugguggcgcuggagaaccaacauacaaucgaucucaccgacuccgaaaugaauaaacuguucgagaagacgaaaaagcagcuucgggaaaacgccgaggauaugggaaauggcugcuuuaagauuuaccacaaaugugacaacgcuugcaucgggagcauuagaaauggcacauaugaucaugacgucuaccgcgacgaggcccugaacaaucgguuccagaucaagggaguggaacucaaaucuggcuacaagaacuggauucuguggaucuccuuugccaucagcugcuuccuucuguguguugcucuccugggguuuauuaugugggccugccagaaaggaaauaucagauguaacauuugcaucuga

SEQ ID NO: 193159 - RNA, 1701 nt, Artificial Sequence; identical to SEQ ID NO: 193018
  derived and/or modified sequence opt5 from hemagglutinin__InfluenzaA__AGQ16340

SEQ ID NO: 193160 - RNA, 1701 nt, Artificial Sequence; identical to SEQ ID NO: 192882
  derived and/or modified sequence opt5 from hemagglutinin__InfluenzaA__AGQ16341

SEQ ID NO: 193161 - RNA, 1701 nt, Artificial Sequence; identical to SEQ ID NO: 192892
  derived and/or modified sequence opt5 from hemagglutinin__InfluenzaA__AGQ16342

SEQ ID NO: 193162 - RNA, 1701 nt, Artificial Sequence
  derived and/or modified sequence opt5 from hemagglutinin__InfluenzaA__AGQ16343
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauugggcuggagugacgcaaaacggcaccucuuccgccugcauuagaggcagcaauucuuccuuuuucagccggcugaacuggcucacacaucugaauuuuaaguauccugcgcuuaacgucaccaugcccaacaaugagcaguucgacaagcuguacaucuggggagugcaccauccugggacagauaaagaccagauuuuucucuaugcccagucuuccggccgcaucaccguuagcacgaagagaucccaacaggcugugauuccgaacaucgggucucggccccgcaucagagauauuccuagccggaucuccauuuacuggacaaucgucaaacccggagacauucugcugaucaauagcaccggcaaccucaucgccccucgcggguacuucaagauuagaucuggaaaauccagcaucaugcggucugacgcucccauuggcaaguguaagagcgaaugcaucacaccgaauggcuccauuccuaacgauaaacccuuucagaaugugaaccgcaucaccuauggggccuguccuagauacgugaagcagucuacccugaaacuugcgacaggaaugcggaauguccccgagaagcaaacgcgcggcaucuucggggccauugcuggauuuaucgaaaacggcugggaggggaugguugacggaugguauggcuucagacaccagaauagcgagggccgggggcaggccgcugaucugaaauccacccaagccgccauugaccagaucaacggaaagcucaauagacugauuggcaaaacaaacgaaaaguuccaccagaucgagaaggaauuuagcgagguggaagggcgcauucaggaucuugagaaauacguggaggacaccaagaucgaucuguggucuuauaaugcugaacuccuggucgcgcuggagaaccaacauacaaucgaccucaccgauuccgaaaugaacaaacuguucgagaagacgaaaaagcagcuucgggaaaaugccgaggacaugggaaacggcugcuuuaagauuuaccacaaaugugauaaugcuugcaucgggagcauuagaaacggcacauaugaccaugacguguaccgcgaugaggcccugaauaaccgguuccagaucaagggaguugaacucaaaucuggcuacaaggacuggauucuguggaucuccuuugccaucagcugcuuccuucuguguguggcucuccugggguuuauuaugugggccugccagaaaggaaauaucagauguaacauuugcaucuga

SEQ ID NO: 193163 - RNA, 1701 nt, Artificial Sequence; identical to SEQ ID NO: 192892
  derived and/or modified sequence opt5 from hemagglutinin__InfluenzaA__AGQ16344

SEQ ID NO: 193164 - RNA, 1701 nt, Artificial Sequence; identical to SEQ ID NO: 192882
  derived and/or modified sequence opt5 from hemagglutinin__InfluenzaA__AGQ16345

SEQ ID NO: 193165 - RNA, 1701 nt, Artificial Sequence
  derived and/or modified sequence opt5 from hemagglutinin__InfluenzaA__AGQ16346
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguagaagcgaaugcaucaccccgaacggcuccauuccuaaugacaagcccuuucagaacgugaaucggaucaccuauggcgcuuguccucgcuacgugaaacagucuacacugaaacuugccacggggaugagaaacguccccgagaagcaaacccggggaaucuucggcgcgauugccggguuuaucgaaaauggaugggagggcaugguugaugggugguauggauucagacaccagaacagcgagggccgcggccaggcugccgaccugaaguccacacaagcugccauugaucagaucaaugggaaacucaaccggcugauuggaaagaccaaugaaaaauuccaccagaucgagaaggaauuuagcgagguggaaggccgcauucaggaccuugagaaguacguggaggauacaaaaaucgaccuguggucuuauaacgccgaacuccuggucgcucuggagaaccaacauaccaucgaucucacggacuccgaaaugaauaagcuguucgagaaaacaaagaaacagcuuagagaaaacgcggaggauauggggaauggaugcuuuaagauuuaccacaagugugacaacgccugcaucggcagcauucggaaugggaccuaugaucauaacguguacagagacgaggcucugaauaaccgcuuccagaucaaaggcguugaacucaagucuggauacaaagacuggauucuguggaucuccuuugccaucagcugcuuccuucuguguguggcccuccugggcuuuauuaugugggcuugccagaaggggaauauccgguguaacauuugcaucuga

SEQ ID NO: 193166 - RNA, 1701 nt, Artificial Sequence; identical to SEQ ID NO: 192882
  derived and/or modified sequence opt5 from hemagglutinin__InfluenzaA__AGQ16347

SEQ ID NO: 193167 - RNA, 1701 nt, Artificial Sequence; identical to SEQ ID NO: 193018
  derived and/or modified sequence opt5 from hemagglutinin__InfluenzaA__AGQ16348

SEQ ID NO: 193168 - RNA, 1701 nt, Artificial Sequence; identical to SEQ ID NO: 192882
  derived and/or modified sequence opt5 from hemagglutinin__InfluenzaA__AGQ16349

SEQ ID NO: 193169 - RNA, 1701 nt, Artificial Sequence
  derived and/or modified sequence opt5 from hemagglutinin__InfluenzaA__AGQ16350
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacggcuuucagaauaaaaagugggaucuguucgucgagcggucuaaagccuauagcaacuguuacccuuaugacgugcccgauuacgcuucccuccgcucucugguugccagcuccgggacccuugaauuuaauaacgagagcuucaauuggacgggagugacccaaaacggcacaucuuccgcuugcauuagacggagcaauucuuccuuuuucagccgccugaacuggcucacccaucugaauuuuaaguauccugcccuuaacgucacaaugcccaacaaugagcaguucgacaagcuguacaucuggggcgugcaccauccugggaccgauaaagaccagauuuuucucuaugcgcagucuuccggaagaaucacgguuagcacaaagcggucccaacaggccgugauuccgaacaucggcucucgccccagaauccggaauauuccuagccgcaucuccauuuacuggaccaucgucaaacccggggauauucugcugaucaacagcacaggaaaucucaucgcuccuagaggcuacuucaagauucggucugggaaauccagcaucaugcgcucugacgcccccauuggaaaguguaagagcgaaugcaucaccccgaacggcuccauuccuaaugacaaacccuuucagaacgugaauagaaucaccuauggcgcuuguccucgguacgugaagcagucuacacugaaacuugccacggggaugcgcaacguccccgagaagcaaaccagaggaaucuucggcgcgauugccggguuuaucgaaaauggaugggagggcaugguugaugggugguauggauuccggcaccagaacagcgagggcagaggccaggcugccgaccugaaauccacacaagcugccauugaucagaucaaugggaagcucaaccgccugauuggaaaaaccaaugaaaaguuccaccagaucgagaaggaauuuagcgagguggaaggccggauucaggaccuugagaaauacguggaggauacaaagaucgaccuguggucuuauaacgccgaacuccuggucgcucuggagaaccaacauaccaucgaucucacggacuccgaaaugaauaaacuguucgagaagaccaaaaagcagcuuagagaaaacgcggaggauauggggaauggaugcuuuaagauuuaccacaaaugugacaacgccugcaucggcagcauucgcaaugggacauaugaucauaacguguaccgggacgaggcucugaauaacagauuccagaucaagggcguugaacucaaaucuggauacaaggacuggauucuguggaucuccuuugccaucagcugcuuccuucuguguguggcccuccugggcuuuauuauguggaccugccagaaagggaauauccgcuguaacauuugcaucuga

SEQ ID NO: 193170 - RNA, 1701 nt, Artificial Sequence
  derived and/or modified sequence opt5 from hemagglutinin__InfluenzaA__AGQ47719
augaaggccauccugcucgugcugcuuugcaccuucacagcuacgaacgccgacacccuguguauuggcuaccacgcgaauaacagcacagauaccgucgacacaguucucgagaaaaaugugaccgugacacauuccgucaaccugcuugaagauagacacaaugggaagcugugcaaacucggaggcaucgcuccccugcaucuggggaaguguaacauugccggauggcuccugggcaauccugagugcgaacuucuguuuaccgugucuagcugguccuauaucguugagacgucuaacagcgacaaugggaccuguuacccgggagauuucauuaacuaugaggaacuccgggagcagcuguccucugugagcuccuuugaacgcuucgagaucuuucccaaaacaagcucuuggccugaccacgaaaccaauagaggcgucacagccgcuugccccuacgccggcgcuaacuccuucuaucggaaucuuaucuggcuggugaagaaggggaacagcuacccuaaacucucuaaguccuauguuaauaacaaaggaaaggaggugcugguccuguggggcauucaucaucccccuaccagcacggaucaacagucucucuaccagaacgccgacgcguacguguuugugggguccagcaaauauaaucgcaaguucaagccggagaucgccgcuagacccaaaguccggggacaggccggccgcaugaacuacuauuggacacugauugaaccuggggauaccaucacauuugaggcuaccggaaaucuuguugugcccagauacgccuucgcgaugaaccggggcuccggcucugggauuaucauuagcgacgccccuauccacgauuguaauaccaagugccaaacacccaaaggagcuaucaacacgucccugccguuucagaauauucacccugugaccaucggcgaaugucccaaguaugucaaaagcacaaagcuccgcauggccaccgggcugagaaacauuccuucuauccagucccggggacuuuucggcgcuauugccggguuuaucgagggaggcuggacaggcaugaucgacgggugguacggauaucaccaucagaauggccaagggagcggauacgccgcugaucagaaaucuacccagaacgcgauugacggcaucacgaauaaggugaacagcguuauugaaaagaugaauacacaguucaccgccguggggaaagaguucaaccaccuggagaagcgcaucgaaaaucucaacaaaaaggucgacgauggcuuucuggacguguggaccuacaacgcugagcugcucguucugcuugaaaaugagagaacacuggauuuccacgacuccaacgugaaaaaucucuaugaaaagguccggucucaacugcgcaacaaugccaaggagauuggaaacggcugcuuugaguucuaccauaaaugugaugauaccugcauggaaagcgugaagaaugggacauaugacuaccccaaauauuccgaggaaagcaaacuuaacagagaggaaaucgacggagucaagcuggagucuacgcggaucuaccagauucucgccaucuauuccaccgcugccagcucucuggugcugcucguuucccugggcgcgauuagcuuuuggaugugcuccaaugggucucuucaguguagaaucugcauuuga

SEQ ID NO: 193171 - RNA, 1698 nt, Artificial Sequence; identical to SEQ ID NO: 185139
  derived and/or modified sequence opt5 from hemagglutinin__InfluenzaA__AGQ47728

SEQ ID NO: 193172 - RNA, 1701 nt, Artificial Sequence
  derived and/or modified sequence opt5 from hemagglutinin__InfluenzaA__AGQ47740
augaaggccagacugcucgugcugcuuugcgcucuggccgcgaccgacgcugauacaaucuguauuggcuaccacgccaacaauagcacggacaccgucgauacacuccuggagaaaaacguuaccgugacacauuccgugaaucuucuggaagacucucacaacgggaagcucugcaaacugaagggaaucgcuccccugcagcucggcaaauguaauauugccggguggcugcuuggaaacccugagugcgauagccugcucccggcccgguccuggucuuauaucgucgaaacccccaauagcgagaacggcgcuuguuacccuggggacuucauugauuaugaagaacugcgcgagcaacuuuccucugugagcucccuggaaagauuugagaucuuccccaaggaaagcucuuggccuaaucauaacacaaucaagggaguuaccgccuccugcagccaccggggccagucuuccuuuuaccgcaaucuccuguggcugacgaaaaagggcgacagcuaucccaaacucaacaauucuuacgugaacaauaaggggaaagagguccuggugcuuuggggaguucaucacccuuccagcuccaacgagcagcagucucuguauagaaacgaaaaugcguacgugagcgucguguccagcaacuacaaucggcgcuucaccccggagauugccgcuagacccaaggugcgggaucaaacaggccgcaugaacuauuacuggacccuccuggaaccuggggacacaaucauguuugaggccaccggaaaucuuauugcucccugguaugccuucgcgcugucuagaggcuuuggguccggaaucauuacgagcaacgccucuaugcacgaauguaauacaaagugccagaccccucagggcgcuaucaacagcucccuccccuuccagaauauucauccggucacaaucggcgaguguccuaaauacguucggucuaccaagcugcgcauggugaccgggcugagaaacauccccagcauucaaucccggggacucuuuggcgccaucgcuggguucauugagggaggcuggacagggaugaucgauggaugguauggcuaccaccaucagaaugaacagggcagcggguaugccgccgaccagaaaucuacgcaaaacgcuauuaauggaaucaccaacaaggucaauuccgugaucgagaaaaugaacacacaguuuaccgcggugggcaaggaguucaacaaucuggagaaacgcauggaaaaccuuaauaagaagguugaugacggguuucuggacauuuggacauacaacgccgagcuccuggugcuucuggagaaugaaagaacccucgauuuccacgaccugaacgucaaaaaucuguacgagaaggugaaaagccagcucaagaacaaugcuaaagaaaucggaaacggcugcuucgaguuuuaucacaagugugauaaugaaugcauggagucuguucggaacgggacguacgacuauccuaaguacuccgaggaaagcaaacugaauagagagaagauugauggcgugaaacuugaauccaugggagucuaucaaauccuggccauuuacucuacaguggccagcucccucguccugcuggugucucuuggcgcuaucagcuucuggaugugcuccaacgggagccuccagugucgcaucugcauuuga

SEQ ID NO: 193173 - RNA, 1701 nt, Artificial Sequence
  derived and/or modified sequence opt5 from hemagglutinin__InfluenzaA__AGQ47752
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaaaagcuccccugcagcugggcaaguguaauauugccggguggguccucggaaacccugagugcgaaucccugcuuucuaaucggagcugguccuauaucgccgagaccccgaacucugaaaauggcauuuguuaccccggggauuucgccgacuaugaggagcugcgcgaacaacucagcuccgugagcucuuuugagagauucgaaaucuuuccuaaggagcgguccuggcccaaacauaacacaauccgcggaguuaccgcugccugcagccacgcgggcaagucuuccuucuacaaaaaucugguguggcuuacggaggccaacggcagcuauccugcucugucuaccuccuacgucaauaaccaggaaaaggaggugcucguucuguggggagugcaucaccccagcaauauugaggaacagagaacacuguaucggaaagauaacgccuacgucuccguggugucuagcaacuacaaucgcagauuuaccccugaaaucgcuaagcggccgaagguccgcgaccagcccgggagaaugaacuauuacuggacacuccuggagccuggcgauaccauuaucuucgaggccacggggaaucuuauugcgcccugguaugccuuugcucugucccggggaccuggcagcgggaucauuacaucuaacgcccccauggacgaaugugauaccaaaugccaaacaccgcagggagcuaucaauuccagccucccuuuccagaacauccaccccguuaccauuggcgaguguccuaaguacgugcgcucuaccaaacugagaauggugacaggccuucggaauauccccagcauucagucccgcgggcuguuuggagccaucgccggcuucauugaagggggauggacgggcaugauggacgggugguauggauaccaucaccaaaacgagcagggcucuggcuaugcugcggaucaaaagagcacccagaaugccaucaacgggaucacaaauaaagucaacuccgugauugaaaagaugaauacccaguuuacagcuguuggaaaagaguucaacaagcucgagaagagaauggaaaaucugaacaaaaagguggacgacggcuuucuggauaucuggaccuacaacgccgagcuccugguccuucuggaaaaugagcggacgcucgacuuccaugauagcaacgugaaaaaucuguacgaaaagguuaaaaaccagcuuagaaauaacgccaaggagcuggggaauggaugcuucgaguuuuaucacaagugugacaacgaaugcauggagucugugaaaaauggcacauacgauuaucccaaguacuccgaagagagcaaacucaaccgcgagaagauugacggggucaaacuggaaucuaugggcguguaucggauccuggcuauuuacuccaccgucgccagcucccucgugcugcuuguuucucugggagcgaucagcuucuggaugugcuccaauggcucucuccaguguagaaucugcauuuga

SEQ ID NO: 193174 - RNA, 1701 nt, Artificial Sequence
  derived and/or modified sequence opt5 from hemagglutinin__InfluenzaA__AGQ47764
augaaggccaaacugcucauccugcuuugcgcucugaccgccacagacgcggauacgauuuguaucggcuaccacgcuaacaauagcaccgacacaguggauaccguccucgagaagaacguuacagugacccauuccgugaaucugcuugaagacucucacaacgggaaacugugcagacucaagggaauugccccgcugcagcugggcaaauguaauaucgccggguggauucucggaaacccugagugcgaaagccugcuuuccaagcggucuuggagcuauaucgcugagacacccaauuccgaaaacggcgccuguuaccccggggauuucgcugacuaugaggagcugcgcgaacaacucucuagcgucuccagcuuugagagauucgaaaucuuuccuaaggagcggucuuggcccaaacauaauauuacccgcggagugacggccgcgugcucccacgccggcaagagcucuuucuacaaaaaccugcuuuggcugaccgagacagauggcuccuauccuaagcucagcaaaucuuacguuaauaacaaggaaaaggaggugcugguccuguggggagugcaucaccccuccaauaucgaagaccagaaaacccucuauagaaaggagaacgcuuacguuagcguggucuccucuaauuacaaccggcgcuuuacaccugaaauugccgagagaccgaaagugcgggggcaggcuggccgcaucaacuauuacuggacccugcuugagcccggggauacgauuaucuucgaagccaauggaaaccugauugcgccuugguaugccuuugcucucagcagagacuucggcuccgggaucaucacaagcaaugccucuauggaugagugugacaccaagugccagacaccccaaggagcuauuaacuccagccugccuuuucagaauauccaccccgugaccauuggcgaauguccgaaauacgucaagucuaccaaacuucggaugguuacaggccugcgcaacaucccuagcauucaguccagaggacucuucggggccaucgccggcuuuaucgaagggggauggacgggcaugauugaugggugguauggauaccaucaccagaaugaacaaggcucuggcuaugcugcggaccaaaagagcacccagaacgccaucaaugggauuacaaacaaggucaauuccgugaucgagaaaaugaacacccaguucacagcugugggaaaggaguuuaauaaacuggaaaagcggauggagaaccugaauaaaaagguggacgauggcuuccucgacauuuggaccuacaacgccgaacugcuuguucugcucgagaacgaacgcacgcuggauuuccaugacagcaaugugaagaaccuuuacgagaaagucaagaaucagcugagaaacaaugccaaagagaucgggaacggaugcuuugaguucuaucacaaguguaauaacgagugcauggaaucugugaaaaauggcacauacgauuaucccaaguacuccgaggagagcaagcucaaccgggagaaaaucgacgggguuaagcuggaaucuaugggcguguaucagauucuggcuaucuacuccaccgucgccagcucccucgugcugcuugucucucugggagcgauuagcuuuuggaugugcuccaauggcucucuccaguguagaaucugcauuuga

SEQ ID NO: 193175 - RNA, 1701 nt, Artificial Sequence
  derived and/or modified sequence opt5 from hemagglutinin__InfluenzaA__AGQ47776
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaauugccccgcugcagcugggcaaauguaauaucgccggguggauucucggaaacccugagugcgaaucccugcuuucuaagcggagcugguccuauaucgcugagacccccaauucugaaaacggcacauguuaccccggggauuucgccgacuaugaggagcugcgcgaacaacucagcuccgucagcucuuuugagagauucgaaaucuuuccuaaggagcgguccuggcccaaacauaauauuaacaucggagugaccgcugccugcagccacgcgggcaagucuuccuucuacaaaaaucugcuuuggcugacggagaaggauggcagcuauccuaaccucaauaaaucuuacguuaacaagaaggaaaaagaggugcugguccuguggggagugcaucaccccuccaauauugaagaccagaagacccucuaucgcaaagagaacgccuacguuagcguggucuccucuaacuacaauagacgguuuacaccugaaaucgcugagcgcccgaaggugagagggcaggccggccggaugaacuauuacuggacccugcuugagcccggggauacaauuaucuucgaagcuaauggaaaccugauugccccuugguaugcguuugcccucagccgcggccugggguccggaaucaucaccagcaaugcuucuauggacgagugugauacgaaaugccagacaccccaaggcgccauuaacuccagccuuccuuuccagaauauccaccccuuuaccauuggcgaauguccgaaguacgugagaucuacaaaacugcggauggucaccgggcuccgcaacaucccuagcauucaguccagaggacuguucggcgcuaucgccggguuuaucgagggaggcuggaccgggaugauugacggaugguauggcuaccaucaccagaaugaacaaggcucuggguaugccgcugaucagaaaagcacacagaacgcgaucaauggaauuacgaacaagguuaauuccgugaucgagaaaaugaacacccaguucacagccgugggcaaggaguuuaauaaacuggaaaagcggauggagaaccucaacaaaaaggucgacgacggguuccuggauauuuggaccuacaaugcugaacuucuggugcuccuggagaacgaacgcacacuugacuuccaugauagcaauguuaagaaccuguacgagaaagugaagaaucaacucagaaacaaugccaaagagaucggaaacggcugcuuugaguucuaucacaaguguaauaacgaaugcauggaaucugucaaaaaugggaccuacgacuaucccaaguacuccgaggagagcaagcugaaccgggaaaagaucgauggcgugaagcuggagucuaugggaguuuaucagauucucgccaucuacuccacgguggcuagcucccugguccuucuggugucucucggcgccauuagcuuuuggaugugcuccaaugggucucugcaguguagaaucugcauuuga

SEQ ID NO: 193176 - RNA, 1701 nt, Artificial Sequence
  derived and/or modified sequence opt5 from hemagglutinin__InfluenzaA__AGQ47788
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgccccgcugcagcugggcaaauguaauauugccggguggauccucggaaacccugagugcgaaucccuguucucuaaaaagagcugguccuauauugcugagacccccaauucugaaaacggcacauguuaccccggguauuuugccgauuacgaggagcuucgggaacaacugagcuccgugagcucuuucgagcgcuuugaaaucuucccuaaggagagauccuggcccaagcauaauguuacccggggagugacggcugccugcagccacaaaggcaagucuuccuuuuaucgcaaccuccuguggcuuaccgagaaagacggcagcuacccuaaucugucuaaguccuaugucaacaauaaggaaaaagaggugcucguucuguggggagugcaucaccccagcaacaucgaagaucagaagacacuguacagaaaagagaaugcguacgucuccguggugucuagcaacuauaaccggcgcuucaccccugaaauugccgagagaccgaagguccgggggcaggcuggccgcaucaauuacuauuggacacuccuggagcccggggacaccauuaucuuugaagccaacggaaaucuuauugcuccuuggcacgccuucgcgcuguccagaggcuuugggagcggaaucauuacgucuaacgccuccauggaugagugugacacaaaaugccagacaccccaaggcgcuaucaauagcucucucccuuuccagaacauccaucccguuaccauuggcgaauguccgaaguacgugcggagcaccaaacugcgcauggugaccgggcuuagaaauaucccuuccauucagucucggggacuguuuggcgccaucgcuggguucauugagggaggcuggacagggaugaucgauggaugguauggcuaccaccaucagaacgaacaaggcagcggguaugccgccgaccagaaguccacgcagaaugcuaucaacggaauuaccaauaaggucaacagcgugaucgagaaaaugaauacacaguuuaccgcgguuggcaaggaguucaacaaacucgaaaagcgcauggagaaucugaacaaaaagguggaugacggguuccuggacauuuggacauacaacgccgaacuccugguccuucuggagaaugaaagaacccucgauuuucacgacucuaacgugaagaaucuguacgagaaaguuaagucccaacuuaaaaacaaugcuaaggagaucggaaacggcugcuucgaauuuuaucacaaauguaauaacgagugcauggaaagcgugaagaaugggacguacgauuaucccaaguacucugaggaguccaaacugaaccgggaaaagauugacggcgucaaacucgagagcaugggaguguaucagauccuggccaucuacuccacagucgccucuagccuggugcuccugguuucccuuggcgcuauuucuuucuggaugugcagcaaugggucccugcaguguagaaucugcauuuga

SEQ ID NO: 193177 - RNA, 1701 nt, Artificial Sequence
  derived and/or modified sequence opt5 from hemagglutinin__InfluenzaA__AGQ47800
augaaggccagacugcucgugcugcuuugcgcucuggccgcgaccgacgcugauacaaucuguauuggcuaccacgccaacaauagcacggacaccgucgauacaauccucgagaaaaacguuaccgugacacauuccgugaaucugcuugaagacucucacaacgggaagcugugccggcucaaaggaauugccccgcugcagcugggcaaguguaauaucgcuggguggauucucggaaacccugagugcgaaagccugcuuuccgagcgcucuuggagcuauaucgucgaaauccccaauuccgagaacggcaccuguuaccccggggauuucacagacuaugaggaacugagagagcaacucucuagcguguccagcuuugaacgguucgagauuuuuccuaaagagucuuccuggcccaagcauaauaccgcccgcggaguuacggcugccugcagccacgcgggcaagucuuccuucuacagaaaccugcuuuggcugaccgaaaaagauggcagcuauccuaaucucaagaacucuuacgugaauaaaaaggggaaagagguccuggugcuguggggaguucaucaccccuccagcaucaaggaacagcagacacucuaucagaaggagaacgccuacguguccgucgugucuagcaauuacaaccggcgcuuuaccccugaaauugcugagagaccgaaagugcgggaccaagccggccgcaugaacuauuacuggacacugcuugagcccggggauaccaucauuuucgaagcuaauggaaaccugaucgccccuugguaugcguuugcccucuccagaggcuucgggagcggaauuaucacgucuaaugcuuccaugcacgagugugacacaaagugccagacaccccagggcgccaucaacagcucucugccuuuucagaauauucaucccgucaccaucggcgaauguccgaaauacguucggagcaccaaacuucgcauggugaccgggcugagaaacauuccuuccauccaaucucggggacucuucggcgcuauugccggguuuaucgagggaggcuggacagggaugaucgauggaugguauggcuaccaccaucagaaugaacagggcagcggguaugccgcugaccagaaguccacgcaaaacgcgauuaauggaaucaccaacaaggugaauagcgucauugagaaaaugaacacacaguucaccgccgugggcaaggaguuuaauaaccuggaaaagcgcauggagaaucugaacaaaaagguugaugacggguuccucgacaucuggacauacaacgcugaacugcuuauucugcucgagaaugaaagaacccuggauuuccacgacucuaacgugaaaaaucuuuacgagaaggucaaaucccagcugcggaacaaugccaaggagaucggaaacggcugcuuugaguucuaucacaaguguaauaacgaaugcauggaaagcgugaaaaaugggacguacgauuaucccaaguacucugaggaguccaaacucaacagagaaaagaucgacggcguuaaacuggagagcaugggaguguaucaaauucuggccaucuacuccacagucgcuucuagccucgugcugcuugucucccugggcgccauuucuuuuuggaugugcagcaaugggucccuccagugucgcaucugcauuuga

SEQ ID NO: 193178 - RNA, 1701 nt, Artificial Sequence
  derived and/or modified sequence opt5 from hemagglutinin__InfluenzaA__AGQ47811
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgccccgcugcagcugggcaaauguaauauugccggguggauccucggaaacccugagugcgaaucccuguucucuaaaaagagcugguccuauauugcugagacccccaauucugaaaacggcacauguuaccccggguuuuucgccgauuaugaggagcuucgggaacaacugagcuccgugagcucuuuugagcgcuucgaaaucuuuccuaaggagagauccuggcccaagcauaauguuacccggggagugacggcugccugcagccacaaaggcaagucuuccuucuaccgcaaccuccuguggcuuaccgagaaaaauggcagcuauccuaaccugucuaaguccuacgucaauaacaaggaaaaagaggugcucguucuguggggagugcaucaccccagcaauaucgaagaccagaagacaauuuauagaaaagagaacgcguacgucuccguggugucuagcaacuacaaucggcgcuuuaccccugaaaucgccgagagaccgaagguccgggggcaggcuggccgcauuaacuauuacuggacacugcucgagcccggggauaccaucauuuucgaagccaauggaaaccugaucgcuccuuggcacgccuuugcgcuuuccagaggcuucgggagcggaauuaucacgucuaaugccuccauggacgagugugauacaaaaugccagacaccccaaggcgcuaucaacagcucucugccuuuucagaauauucaucccguuaccaucggcgaauguccgaaguaugugcggagcaccaaacuccgcauggugaccgggcugagaaacauuccuuccauccagucucggggacuuuucggcgccauugcuggguuuaucgagggaggcuggacagggaugaucgacggaugguacggcuaucaccaucagaaugaacaaggcagcggguacgccgccgaucagaaguccacgcagaacgcuauugacggaaucaccaauaaggucaacagcgugauugagaaaaugaauacacaguucaccgcgguuggcaaggaguucaacaaacuggaaaagcgcauggagaaucucaacaaaaagguggaugacggguuucuggacaucuggacauauaacgccgaacugcucguccugcuugagaaugaaagaacccuggauuuccacgacucuaacgugaagaaucucuacgagaaaguuaagucccaacugaaaaacaaugcuaaggagauuggaaacggcugcuuugaguucuaccacaaauguaauaacgaaugcauggaaagcgugaagaaugggacguaugauuaccccaaguauucugaggaguccaaacuuaaccgggaaaagaucgacggcgucaaacuggagagcaugggaguguaccagauccucgccauuuauuccacagucgccucuagccuggugcugcucguuucccugggcgcuaucucuuuuuggaugugcagcaaugggucccuucaguguagaauuugcaucuga

SEQ ID NO: 193179 - RNA, 1701 nt, Artificial Sequence
  derived and/or modified sequence opt5 from hemagglutinin__InfluenzaA__AGQ47823
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccuaaaugcgagucccucuuuucuaaggaaagcugguccuacaucgccgagacaccgaaucccgaaaacggcaccuguuauccuggguacuucgccgacuaugaggagcugcgggaacaacuuucuagcguuuccagcuuugagcgcuucgaaauuuuucccaaggagucuuccuggccuaaucauacggugaccaaaggagucacaaccagcugcucucacaacggcaaguccagcuucuacagaaaucugcucuggcugacagagaaaaacggccuuuaucccaaucugucuaaguccuacgugaacaauaaagaaaaggagguucucgugcuguggggaguccaucacccuagcaacauccgggaucagcgcgcuaucuaccacaccgaaaacgccuauguguccguggucucuagccauuacuccagacgguuuacgccggagauugcgaagcgccccaaaguuagagggcaggaaggccggaucaauuauuacuggacacugcucgagccuggggacaccauuaucuucgaggccaacggaaaucugauugcucccugguaugccuuugcucuuagccgcggcuucgggucuggaaucauuacauccaacgccagcauggaugaaugugacgcgaagugccagaccccucaaggcgccaucaauucuagccugcccuuucagaacgugcacccggugaccaucggcgaguguccuaaauacgucagauccacaaagcuccggauggugacggggcugcgcaauauucccucuauccagagcagaggacuuuucggcgcuauugccggguuuaucgaaggaggcuggaccgggaugauugauggaugguauggcuaccaucaccagaacgagcaaggcuccggguacgcugccgaccagaaaagcacacagaaugccaucaacggaaucaccaauaagguuaacucugugauugaaaagaugaauacacaguucaccgcugucggcaaggaguucaacaagcuggagcggcgcauggaaaaucucaacaaaaagguggaugacggguuucuggauaucuggacguauaacgcggagcugcucguucugcuugaaaauggaagaacacuggacuuccacgacuccaacgugaaaaaucucuacgagaaggucaaaagccaacugaagaacaaugccaaggaaauuggcaacgggugcuuugaguucuaucauaaauguaauaacgagugcauggaaucugugaagaauggcaccuacgauuauccuaaauacuccgaggaaagcaaacuuaaccggggaaaaaucgacggcgucaagcuggaguccauggggguguaucagauucucgcuaucuacucuaccguugccagcucccuggugcugcucgucucucugggagccaucagcuuuuggaugugcuccaauggcagccuucaguguagaauuugcaucuga

SEQ ID NO: 193180 - RNA, 1701 nt, Artificial Sequence
  derived and/or modified sequence opt5 from hemagglutinin__InfluenzaA__AGQ47835
augaagaccaucauugcccugagcuacaucuucugccucgugcugggccaggacuuucccgggaacgauaauuccacagcuacgcuuugucugggacaccaugccgucccuaacggcaccauuguuaaaacaaucaccaaugaccaaauugaggugacaaacgcgaccgaacucgugcagucuagcuccacagggaagaucugcaauaacccgcacagaauccuggauggaauuaauuguacccuuaucgacgcucugcucggcgauccccauugcgacggguuccagaacgagacgugggaucuguuugucgaacggucuaaagccuucagcaauuguuauccuuacuaugugcccgacuacgccucccugcgcucucucguugcuagcuccggaacccuggaguuuauuaacgaaggcuucaauuggacaggcgugacccagaacgggggaagcaaugccugcaagagaggcccuaacucuggguuuuucucccggcuuaauuggcuguauaaaagcggaacaaccuaccccguccucaacgugacgaugccuaacaaugauaacuuugacaagcuguauaucuggggcguucaccauccgucuacagaucaagagcagaccaaucuuuacgugcaggcuuccgggcgcgucacagugagcaccaagagaucucagcaaaccauuacacccaacaucggaucccggccuugggugcgcggccugagcuccagaauuucuaucuacuggacgaucgucaaacccggcgacauucucguuaucaauagcaacgggaaucugauugccccucggggauauuucaagaugcgcaccggcaaauccagcaucaugagaucugaugcgcccauugggacauguaucuccgagugcaucaccccgaacggaagcauuccuaaugacaagcccuuucagaacgugaauaaaaucacauacggcgccuguccuaaguaugugaagcagaacacccugaaacucgcuacggggaugcggaauguccccgaaaagcagacacgcggaauuuucggcgccaucgcuggcuuuauugagaacgggugggaaggaaugguggacggcugguacggguucagacaccaaaauucugagggaaccggccaggccgcggaucugaaaagcacccaggccgcuaucgaccaaaucaacgggaagcugaaccggguuauugagaaaacaaaugaaaaguuccaccagaucgagaaagaauuuuccgagguggaaggccgcauucaggaucuggagaaguaugucgaggacaccaagaucgaucucuggucuuacaacgccgaacugcuuguggcucuggagaaucagcauacaauugaccucacggauagcgaaaugaacaaacuguucgagaagaccagacggcaacugagagaaaaugccgaggacaugggaaacggcugcuuuaaaaucuaucacaagugugauaaugccugcauuggguccauccgcaacggaacauacgaccaugauguuuaccgggacgaggcucucaauaacagauuccagaucaaaggcguggaacuuaagagcggguauaaggacuggauucuuuggaucucuuuugcgauuuccugcuuccugcucugugucgugcugcuuggauuuaucaugugggccugccagaaaggcaauauucgcuguaacaucugcaucuga

SEQ ID NO: 193181 - RNA, 1701 nt, Artificial Sequence
  derived and/or modified sequence opt5 from hemagglutinin__InfluenzaA__AGQ47847
augaaggccagacugcucauccugcuuugcgcucuggccgcgaccgacgcugauacaauuuguaucggcuaccacgccaacaauagcacggacaccguggauacaguccucgagaaaaacguuaccgugacacauuccgugaaucugcuugaagacucucacaacgggaagcugugccggcucaaaggaauugcuccccugcagcugggcaaguguaauaucgccggguggcuccugggaaacccugagugcgauagccuucugccggccuccucuuggagcuauauugucgaaacccccaauuccaaaaacggcaucuguuacccuggggacuucaucgauuaugaggaacuccgcgagcaacugucuagcguguccagcuuugagagauucgaaauuuuucccaaggagucuuccuggccuaagcauaauacaaccaaaggaguuacggcugccugcagccacgcgggcaagucuuccuucuaccggaaccuucuguggcucaccaaaaaggaagacagcuaucccaaacugucuaauuccuacgugaacaagaagggcaaagagguccuggugcucuggggaguucaucacccuagcaauuccaaggagcagcagacacuguaucagaacgaaaaugccuacgugucugucgugagcuccaacuacaaccgcagauuuaccccggagaucgcugaacggcccaaagugcgcgaucaagccgggagaaugaauuauuacuggacacuucuggagccuggcgacaccauuaucuucgaagcuaacgggaaucucauugcccccugguaugcguuugcccugagccggggauucggcucugggaucauuacguccaacgcuagcaugcacgaguguaauacaaagugccagaccccucagggagccaucaacucuagccuucccuuucagaauauccauccggucacaauuggcgaguguccuaaauacguuaaguccgcuaaacugcgcauggugaccggccucagaaacauccccucuauucaaagccgggggcuguucggagccaucgccggcuuuauugaagggggauggaccggcaugaucgaugggugguauggauaccaccaucagaaugagcagggcuccggcuaugcugcggaccagaaaagcacacaaaacgccaucaaugggauuacgaacaaggucaauucugugaucgaaaagaugaacacccaguucacagcugugggaaaggaguuuaauaaccuggaaaaacgcauggagaaccucaauaagaaaguugaugacggcuuccuggacauuuggaccuacaacgccgagcuucuggugcuccuggaaaaugagagaacacuugauuuccacgacuccaacgucaagaaucuguacgaaaaggugaaaauccagcucaagaacaaugccaaagagauugggaacggaugcuuugaguucuaucacaagugugauaaugaaugcauggagagcguucggaacggcaccuacgacuauccuaaauacucuaaggaauccaagcugaaucgcgagaaaaucgauggggugaagcuggaacccaugggcgucuaucaaauccucgcuauuuacagcacgguggccuccucucugguccuucuggugagccucggagcgaucuccuuuuggaugugcucuaacggcagccugcaguguagaauuugcaucuga

SEQ ID NO: 193182 - RNA, 1701 nt, Artificial Sequence
  derived and/or modified sequence opt5 from hemagglutinin__InfluenzaA__AGQ47870
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauagacacaaugggaagcugugcaaacucggaggcaucgcuccccugcaucuggggaaguguaacauugccggauggcuccugggcaauccugagugcgaacuucugcucacagugucuagcugguccuauaucguugagaccucuaacagcgacaaugggacguguuacccgggagauuuuauuaacuaugaagaacugcgggagcagcuuuccucugugagcuccuucgaacgcuuugagaucuuccccaaaaccagcucuuggccuaaucacgaaacaaacagaggcgucaccgccgccugccccuacgcuggcgccaauuccuuuuaucggaaccugaucuggcucgugaagaaggggaauagcuacccuaaacugucuaaguccuauguuaacaacaaaggaaaggaggugcugguccucuggggcauucaucaucccccuacaagcaccgaccaacagucucuguaccagaaugcggaugccuacguguucgugggguccagcaaauauaaccgcaaguuuaagccggagaucgcugccagacccaaaguccggggacaggcuggccgcaugaauuacuauuggacgcuuauugaaccuggggacacaaucaccuucgaggccacaggaaaccugguugugcccagauacgcguuugccaugaaucggggcuccggcucugggauuaucauuagcgaugcuccugugcacgacuguaacaccaagugccaaacccccaaaggagccaucaauacaucccucccguuccagaacauccacccugucacgauuggcgaaugucccaaguaugugaaaagcaccaagcugcgcauggcuacagggcuuagaaauaucccuucuauucagucccggggacuguuuggcgccaucgccggguucauugagggaggcuggaccggcaugaucgaugggugguacggauaucaccaucagaacgaacaaggcagcggguacgcugcggaccagcgcucuacacagaaugccaucgauggaauuaccaacaaaguuaauagcgugaucgagaagaugaacacgcaguuuacagcugucggcaaggaguucaaucaccucgagaaaagaauugagaaccugaacaagaaaguggacgacggguuccuggauaucuggaccuacaaugccgaacuccugguucuucuggagaacgaacggacccucgacuuucacgauuccaaugugaagaaccuguaugagaaaguccgcucucaacuuagaaauaacgccaaggagauuggcaauggaugcuucgaauuuuaccauaagugugacgauacaugcauggagagcgugaaaaacggcaccuaugacuaccccaaguauuccgaagagagcaaacugaaucgggaagagaucgauggggucaagcucgagucuacaagaaucuaccagauucuggcuaucuauuccacgguggccagcucucugguucuccuggugucccuuggagcgauuagcuucuggaugugcuccaacggcucucugcagugucgcaucugcauuuga

SEQ ID NO: 193183 - RNA, 1701 nt, Artificial Sequence
  derived and/or modified sequence opt5 from hemagglutinin__InfluenzaA__AGQ47882
augaaggccauccugcucgugcugcuuugcaccuucgcugccacaaacgcggacacgcuguguauuggcuaccacgcuaauaacagcaccgauacagucgacaccguucucgagaaaaaugugacagugacccauuccgucaaccugcuugaagauagacacaaugggaagcugugcaaacucggaggcaucgcuccccugcaucuggggaaguguaacauugccggauggcuccugggcaauccugagugcgaacuucugcucacagugucuagcugguccuauaucguugagaccucuaacagcgacaaugggacguguuacccgggagauuuuauuaacuaugaagaacugcgggagcagcuuuccucugugagcuccuucgaacgcuuugagaucuuccccaaaaccagcucuuggccuaaucacgaaacaaacagaggcgucaccgccgccugccccuacgcuggcgccaauuccuuuuaucggaaccugaucuggcucgugaagaaggagaauagcuacccuaaacugucuaaguccuauguuaacaacaaagggaaggaggugcugguccucuggggcauucaucaucccccuacaagcaccgaccaacagucucuguaccagaaugcggaugccuacguguucgugggauccagcaaauauaaccgcaaguuuaagccggaaaucgcugccagacccaaaguccgggggcaggcuggacgcaugaauuacuauuggacgcuuauugagccuggcgacacaaucaccuucgaagccacagggaaccugguugugcccagauacgcguuugccaugaaucggggauccggcucuggcauuaucauuagcgaugcuccugugcacgacuguaacaccaagugccaaacccccaaaggggccaucaauacaucccucccguuccagaacauccacccugucacgauuggagagugucccaaguaugugaaaagcaccaagcugcgcauggcuacaggccuuagaaauaucccuucuauucagucccgggggcuguuuggagccaucgccggcuucauugaagggggauggaccggcaugaucgauggcugguacggguaucaccaucagaacgagcaaggaagcggcuacgcugcggaccagcgcucuacacagaaugccaucgaugggauuaccaacaaaguuaauagcgugaucgagaagaugaacacgcaguuuacagcugucggaaaggaguucaaucaccucgagaaaagaauugaaaaccugaacaagaaaguggacgacggcuuccuggauaucuggaccuacaaugccgagcuccugguucuucuggaaaacgagcggacccucgacuuucacgauuccaaugugaagaaccuguaugagaaaguccgcucucaacuuagaaauaacgccaaggaaauugggaauggcugcuucgaguuuuaccauaagugugacgauacaugcauggaaagcgugaaaaacggaaccuaugacuaccccaaguauuccgaggaaagcaaacugaaucgggaggagaucgauggcgucaagcucgaaucuacaagaaucuaccagauucuggcuaucuauuccacgguggccagcucucugguucuccuggugucccuuggggcgauuagcuucuggaugugcuccaacggaucucugcagugucgcaucugcauuuga

SEQ ID NO: 193184 - RNA, 1701 nt, Artificial Sequence; identical to SEQ ID NO: 192119
  derived and/or modified sequence opt5 from hemagglutinin__InfluenzaA__AGQ47894

SEQ ID NO: 193185 - RNA, 1701 nt, Artificial Sequence
  derived and/or modified sequence opt5 from hemagglutinin__InfluenzaA__AGQ47906
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcauccaccauccguccacaaaucaagagcagaccagccucuacguucaggccucugggcgcgugaccgucuccacaagacggagccagcaaacgauuauccccaacauuggaucccgcccuugggugagaggccugucuagccggaucuccaucuauuggaccauugugaagcccggcgacguccugguuaucaacagcaaugggaaccucauugcgccucgcggauacuuuaaaaugagaacaggcaagucuuccaucaugcggagcgacgcccccauugauaccuguaucucugagugcaucacaccgaaugggagcauuccuaacgacaaacccuuccagaaugugaacaagaucaccuacggagcuuguccuaaauaugugaagcagaauacgcugaaacuugccacaggcaugcgcaacguccccgaaaagcagaccagagggcuguuuggagcuauugccggcuucaucgagaauggcugggaagggaugauugauggaugguacggcuuucggcaccaaaacuccgaggggaccggacaggcggccgaccucaagucuacacaggcugccaucgaucaaaucaauggcaaacugaaccgcgugauugagaagaccaaugaaaaauuccaccagaucgagaaggaguucagcgaaguugaagggcggauucaggaccuugagaaauauguggaggauacaaagaucgaccugugguccuacaacgcugaacuccuggucgcccuggagaaucagcauacgauugaucucaccgacagcgaaaugaacaagcuguuugagaaaacaagaagacaacuucgcgaaaacgccgaggauaugggcaauggaugcuucaagaucuaucacaaaugugacaacgcuugcauugagucuauccggaauggcaccuacgaccaugauguguauagagacgaagcgcugaacaaucgcuuucagaucaaggggguugagcucaaauccggauacaaggauuggauucuguggaucagcuucgccauuucuugcuuucuucugugugugguccuccugggcuucaucaugugggcuugccagcgggggaacauuagauguaauaucugcaucuga

SEQ ID NO: 193186 - RNA, 1701 nt, Artificial Sequence
  derived and/or modified sequence opt5 from hemagglutinin__InfluenzaA__AGQ47918
augaagaccaucauugcccugagcuacaucuucugccucgcucugggccaggaccuucccgggaacgauaauaacacagccacgcugugucucggacaccaugcggugccuaauggcacccuggucaaaacaauuaccgacgaucaaaucgagguuacaaacgcuaccgaacuugugcaguccucuagcacagggaagauuugcaauaacccgcacagaauccuggacggaaucgauuguacccucauugacgcccugcugggcgauccccauugcgacguguuucagaaugagacgugggaucucuucgucgaacgguccaaagccuuuucuaacuguuauccuuacgacgugcccgauuaugcuagccugcgcucccuuguugccucuagcgggacccuggaguucaucacagaaggauuuaccuggacaggcgugacccagaauggcggguccaacgcuugcaagagaggaccuggcagcggguucuuuucucggcucaauuggcugacgaaauccggaagcacauaccccguccuuaacgugaccaugccuaauaacgacaauuucgauaagcuguauauuuggggcguucaccauccgucuacaaaccaagagcagaccucccucuacgugcaggccagcgggcgcgucaccgugucuacaagacggucccagcaaacgaucauucccaacaucggaagccgcccuugggugagaggccuguccucucggauuagcaucuauuggaccaucgucaagcccggcgacguucuggugauuaauuccaacgggaaucucaucgcgccucgcggauacuuuaaaaugagaacaggcaagagcucuauuaugcgguccgacgcccccaucgauaccuguauuagcgagugcaucacaccgaacgggucuaucccuaaugacaaacccuuccagaacgugaauaagauuaccuacggagcuuguccuaaauaugucaagcagaacacgcugaaacuugccacaggcaugcgcaaugugcccgaaaagcagaccagagggcuguuuggagcuaucgccggcuucauugagaacggcugggaagggaugaucgauggaugguacggcuuucggcaccaaaauagcgaggggaccggacaggcggccgaccucaaguccacacaggcugccauugaucaaaucaacggcaaacugaaucgcguuaucgagaagaccaacgaaaaauuccaccagauugagaaggaguucucugaaguggaagggagaauccaggaccuugagaaauaugucgaggauacaaagauugaccuguggagcuacaaugcugaacuccugguggcccuggagaaccagcauacgaucgaucucaccgacuccgaaaugaacaagcuguuugagaaaacacggagacaacuucgcgaaaaugccgaggauaugggcaacggaugcuucaagauuuaucacaaaugugacaaugcuugcaucgagagcauucggaacggcaccuacgaccaugauguuuauagagacgaagcgcugaauaaccgcuuucagaucaaggggguggagcucaaaucuggauacaaggauuggauccuguggauuuccuucgccaucagcugcuuucuucugugugucgugcuccugggcuucauuaugugggcuugccagcgggggaauaucagauguaacauuugcaucuga

SEQ ID NO: 193187 - RNA, 1701 nt, Artificial Sequence
  derived and/or modified sequence opt5 from hemagglutinin__InfluenzaA__AGQ47930
augaaggccaaccugcucgugcugcuuugcgcucuggccgcggcugacgccgauaccaucuguauuggcuaccacgccaauaacagcacagacacggucgauaccgcucucgagaaaaauguuacagugacccauuccgugaaccugcuugaagacucucacaaugggaagcugugcagacucaaaggaaucgcuccccugcagcugggcaaguguaacauugccggguggcuccugggaaauccugagugcgauccgcuucugcccguccggagcugguccuauaucguggaaacaccuaacucugagaauggcauuuguuaccccggggacuucaucgauuaugaagaacuccgcgagcaacugagcuccguuucuagcuuugaaagauucgagaucuuuccuaaagaauccagcuggcccaaccauaauaccaacaagggagugacagccgcgugcucucacgccggcaaguccagcuucuaccggaaucuucuguggcucaccgagaaagagggcucuuauccuaagcugaaaaacuccuacgucaauaagaaagggaaggaagugcugguucucuggggcauucaucacccgagcaacucuaaggaccagcagaaccuguaucagaaugagaacgcuuacguguccgucgugacgagcaauuacaaccgcagauuuacccccgaaaucgccgagcggccuaaagugcgcgaucaagcuggaagaaugaauuauuacuggacacuucugaagcccggggacaccauuaucuucgaagccaacggaaaucucauugcgccuauguaugccuuugcucugucccggggcuucgggucuggaaucauuacaagcaacgccuccaugcacgaguguaauaccaaaugccagacgccccuuggcgcuaucaacagcucucugccguuucagaauauccauccugucacaauuggcgagugucccaaguacguucgcuccgccaaacucagaauggugaccgggcugcggaacaucccuagcauucagucucgcggacuguucggcgccaucgcuggguuuauugaaggaggcuggacagggaugaucgauggaugguauggcuaccaccaucaaaaugagcagggcagcggguaugcggccgaccagaaguccacccagaacgcuaucaauggaauuaccaacaaagugaacucugucaucgaaaagaugaauauucaauucacagccgugggcaaggaguuuaacaaacucgaaaagagaauggagaaucugaacaaaaagguugaugacggguuccuugacaucuggacguacaaugccgagcugcucgugcugcuugaaaacgagcggacccuggauuuccacgacagcaaugucaaaaaccucuacgaaaaggugaagucccagcugaaaaauaacgcuaaggagauuggaaauggcugcuuugaguucuaucacaaaugugauaacgagugcauggagagcguucgcaaugggacauacgacuaucccaaguacucugaagaguccaaacugaacagagaaaagguggauggcgucaagcucgagagcaugggaaucuaucagauccuggccauuuacucuaccguggcguccagccuuguccugcucgugucccugggcgcuaucucuuuuuggaugugcagcaaugggucccugcaaugucggauuugcaucuga

SEQ ID NO: 193188 - RNA, 1698 nt, Artificial Sequence; identical to SEQ ID NO: 186302
  derived and/or modified sequence opt5 from hemagglutinin__InfluenzaA__AGQ47942

SEQ ID NO: 193189 - RNA, 1698 nt, Artificial Sequence
  derived and/or modified sequence opt5 from hemagglutinin__InfluenzaA__AGQ47954
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuccuacgugaauaaaaaggggaaagagguucuggugcucuggggcauucaucacccgcccaacagcaaggaacagcagaaccuguaucgcaaugagaacgcguacgucucuguggugacguccaauuacaacagacgguuuaccccugaaaucgccgagcgccccaaggucagagaccaggcuggacggaugaauuauuacuggacacuucugaaaccuggggauaccauuaucuucgaggccaacggaaaucucauugcucccauguaugccuuugcgcugagccgcggcuucggguccggaaucauuacaucuaacgccagcaugcacgaauguaauaccaagugccaaacgccgcuuggcgcuaucaacuccagccugccuuaccagaauauccaucccguuacaauuggcgaguguccuaaauaugugagaucugccaagcuccggauggugaccgggcugcgcaacauccccuccauucagagcagaggacuguuuggcgcuaucgccggguucauugaaggaggcuggacagggaugaucgacggaugguacggcuaucaccaucagaaugagcaaggcucuggguacgccgcugaucagaaaagcacccagaacgcgaucaauggaauuaccaacaaggucaacacagugaucgagaaaaugaauauucaguuuacggccguuggcaaggaguucaacaagcucgagaaacggauggaaaaucugaacaagaaaguggacgauggguuucuugacaucuggaccuacaaugcugagcugcucguccugcuugaaaacgagcgcacacuggacuuccacgauuccaaugugaagaaccucuaugaaaaaguuaagucucaacugaagaauaacgccaaagagauuggaaauggcugcuucgaguuuuaccacaagugugacaacgaaugcauggagagcgugagaaaugggaccuaugauuaccccaaauauuccgaagagagcaagcugaaccgggagaaagucgacggcgugaagcucgaaucuaugggaaucuaccagauccuggccauuuauuccacagucgcuagcucucuugugcugcucguuucccugggcgccaucagcuucuggaugugcuccaaugggucucugcaguguagaauuugcaucuga

SEQ ID NO: 193190 - RNA, 1698 nt, Artificial Sequence
  derived and/or modified sequence opt5 from hemagglutinin__InfluenzaA__AGQ47966
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaggaacuccgggagcaacugagcuccgugucuagcuuugaacgcuucgagaucuuuccuaaagaauccagcuggcccgaccauaacaccaauggcgucacagcugccugcucucacgagggcaagaacuccuucuacagaaaucuucuguggcucaccgagaaggaaagcucuuauccuaaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccggcgcuuuaccccugaaaucgccgagagacccaaggucaaagaucaagcuggacggaugaauuauuacuggacacuucugaagccuggggacaccauuaucuucgaggccaacggaaaucucauugcucccauguaugccuuugcgcugagccgcggcuucggguccggaaucauuacaucuaacgccagcaugcacgaauguaauaccaaaugccagacgccgcuuggcgcuaucaacuccagccugccuuaccagaauauccaucccguuacaauuggcgaguguccuaaguaugugagaucugccaaacuccggauggugaccgggcugcgcaacauccccuccauucagagcagaggacuguuuggcgcuaucgccggguucauugaaggaggcuggacagggaugaucgauggaugguacggcuaucaccaucaaaaugagcagggcucuggguacgccgcugaccaaaagagcacccagaacgcgaucaauggaauuaccaacaaagucaacacagugaucgaaaagaugaauauucaguuuacggccguuggcaaggaguucaacaaacucgagaagcggauggaaaaucugaacaaaaagguggaugacggguuucuugacaucuggaccuacaaugcugagcugcucguccugcuugaaaacgagcgcacacuggauuuccacgacuccaaugugaaaaaccucuaugaaaagguuaagucucagcugaaaaauaacgccaaggagauuggaaauggcugcuucgaguuuuaccacaaaugugauaacgaaugcauggagagcgugagaaaugggaccuaugacuaccccaaguauuccgaagagagcaaacugaaccgggagaaggucgauggcgugaagcucgaaucuaugggaaucuaccagauccuggccauuuauuccacagucgcuagcucucuugugcugcucguuucccugggcgccaucagcuucuggaugugcuccaaugggucucugcaaugucgcauuugcaucuga

SEQ ID NO: 193191 - RNA, 1698 nt, Artificial Sequence
  derived and/or modified sequence opt5 from hemagglutinin__InfluenzaA__AGQ47978
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaggaacuccgggagcaacugagcuccgugucuagcuuugaacgcuucgagaucuuuccuaaagaauccagcuggcccgaccauaacaccaauggcgucacagcugccugcucucacgagggcaagaacuccuucuacagaaaucuucuguggcucaccaagaaagagagcucuuauccugaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccggcgcuuuaccccugaaaucgccgagagacccaaggucaaagaucaagcuggacggaugaauuauuacuggacacuucugaagccuggggacaccauuaucuucgaggccaacggaaaucucauugcucccauguaugccuuugcgcugagccgcggcuucggguccggaaucauuacaucuaacgccagcaugcacgaauguaauaccaaaugccagacgccgcuuggcgcuaucaacuccagccugccuuaccagaauauccaucccguuacaauuggcgaguguccuaaguaugugagaucugccaaacuccggauggugaccgggcugcgcaacauccccuccauucagagcagaggacuguuuggcgcuaucgccggguucauugaaggaggcuggacagggaugaucgauggaugguacggcuaucaccaucaaaaugagcagggcucuggguacgccgcugaccaaaagagcacccagaacgcgaucaauggaauuaccaacaaagucaacacagugaucgaaaagaugaauauucaguuuacggccguuggcaaggaguucaacaaacucgagaagcggauggaaaaucugaacaaaaagguggaugacggguuucuugacaucuggaccuacaaugcugagcugcucguccugcuugaaaacgagcgcacacuggauuuccacgacuccaaugugaaaaaccucuaugaaaagguuaagucucagcugaaaaauaacgccaaggagauuggaaauggcugcuucgaguuuuaccacaaaugugauaacgaaugcauggagagcgugagaaaugggaccuaugacuaccccaaguauuccgaagagagcaaacugaaccgggagaaggucgauggcgugaagcucgaaucuaugggaaucuaccagauccuggccauuuauuccacagucgcuagcucucuugugcugcucguuucccugggcgccaucagcuucuggaugugcuccaaugggucucugcaaugucgcauuugcaucuga

SEQ ID NO: 193192 - RNA, 1698 nt, Artificial Sequence
  derived and/or modified sequence opt5 from hemagglutinin__InfluenzaA__AGQ47990
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaagaacuccgggagcaacugagcuccgugucuagcuuugaacgcuucaaaaucuuuccuaaggaguccagcuggcccgaccauaacaccaauggcgucacagcugccugcucucacgaaggcaagaacuccuucuacagaaaucuucuguggcucaccaaaaaggagagcucuuauccugagcugaaaaacuccuacgugaauaagaaagggaaggaaguucuggugcucuggggcauucaucacccgcccaacagcaaggagcagcagaaccuguaucagaaugaaaacgcguacgucucuguggugacguccaauuacaaccggcgcuuuaccccugagaucgccgaaagacccaaagucaaggaucaagcuggacggaugaauuauuacuggacacuucugaaaccuggggacaccauuaucuucgaggccaacggaaaucucauugcucccauguaugccuuugcgcugagccgcggcuucggguccggaaucauuacaucuaacgccagcaugcacgaguguaauaccaagugccagacgccgcuuggcgcuaucaacuccagccugccuuaccagaauauccaucccguuacaauuggcgaauguccuaaauaugugagaucugccaagcuccggauggugaccgggcugcgcaacauccccuccauucagagcagaggacuguuuggcgcuaucgccggguucauugagggaggcuggacagggaugaucgauggaugguacggcuaucaccaucaaaaugaacagggcucuggguacgccgcugaccagaaaagcacccagaacgcgaucaauggaauuaccaacaaggucaacacagugaucgagaagaugaauauucaauuuacggccguuggcaaagaguucaacaagcucgagaaacggauggagaaucugaacaagaaaguggaugacggguuucuugacaucuggaccuacaaugcugaacugcucguccugcuugagaacgaacgcacacuggauuuccacgacuccaaugugaagaaccucuaugagaagguuaaaucucagcugaagaauaacgccaaagaaauuggaaauggcugcuucgaguuuuaccacaagugugauaacgagugcauggaaagcgugagaaaugggaccuaugacuaccccaaauauuccgaggaaagcaagcugaaccgggagaaggucgauggcgugaaacucgagucuaugggaaucuaccagauccuggccauuuauuccacagucgcuagcucucuugugcugcucguuucccugggcgccaucagcuucuggaugugcuccaaugggucucugcaaugucgcauuugcaucuga

SEQ ID NO: 193193 - RNA, 1698 nt, Artificial Sequence
  derived and/or modified sequence opt5 from hemagglutinin__InfluenzaA__AGQ48002
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugggcagcugguccuauaucguugaaacaccuaacucugagaaugggauuuguuaccccggagacuucaucgauuaugaggagcuccgggagcaacugagcuccgugucuagcuuugaacgcuucaaaaucuuuccuaaggaguccagcuggcccgaccauaacaccaauggcgucacagcugccugcucucacgaaggcaagaacuccuucuacagaaaucuucuguggcucaccaaaaaggagagcucuuauccugagcugaaaaacuccuacgugaauaagaaacggaaggaaguucuggugcucugggggauucaucacccgcccaacagcaaggagcagcagaaccuguaucagaaugaaaacgcguacgucucuguggugacguccaauuacaaccgcagauuuaccccugagaucgccgaacggcccaaagucaaggaucaagcuggacgcaugaauuauuacuggacacuucugaaaccuggcgacaccauuaucuucgaggccaacgggaaucucauugcucccauguaugccuuugcgcugagcagaggauucggcuccgggaucauuacaucuaacgccagcaugcacgaguguaauaccaagugccagacgccgcuuggagcuaucaacuccagccugccuuaccagaauauccaucccguuacaauuggcgaauguccuaaauaugugcggucugccaagcuccgcauggugaccggccugagaaacauccccuccauucagagccgggggcuguuuggagcuaucgccggcuucauugaagggggauggacaggcaugaucgaugggugguacggauaucaccaucaaaaugaacagggcucuggcuacgccgcugaccagaaaagcacccagaacgcgaucaaugggauuaccaacaaggucaacacagugaucgagaagaugaauauucaauuuacggccguuggaaaagaguucaacaagcucgaaaaacgcauggagaaucugaacaagaaaguggaugacggcuuucuugacaucuggaccuacaaugcugaacugcucguccugcuugagaacgaaagaacacuggauuuccacgacuccaaugugaagaaccucuaugagaagguuaaaucucagcugaagaauaacgccaaagaaauugggaauggaugcuucgaguuuuaccacaagugugauaacgagugcauggaaagcgugcggaauggcaccuaugacuaccccaaauauuccgaggaaagcaagcugaaccgcgagaaggucgauggggugaaacucgagucuaugggcaucuaccagauccuggccauuuauuccacagucgcuagcucucuugugcugcucguuucccugggagccaucagcuucuggaugugcuccaauggcucucugcaauguagaauuugcaucuga

SEQ ID NO: 193194 - RNA, 1698 nt, Artificial Sequence
  derived and/or modified sequence opt5 from hemagglutinin__InfluenzaA__AGQ48014
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccuggcugcgauccgcuucugcccguggggagcugguccuauaucguugagacaccuaacucugaaaauggaauuuguuaccccggcgacuucaucgauuaugaggaacuccgggagcaacugagcuccgugucuagcuuugagcgcuucaaaaucuuuccuaaggaauccagcuggcccgaccauaacaccaauggcgucacagcugccugcucucacgaggggaagaacuccuucuacagaaaucuucuguggcucaccaaaaaggaaagcucuuauccugagcugaaaaacuccuacgugaauaagaaacggaaggagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaaagucaaggaucaagcuggacgcaugaauuauuacuggacacuucugaaaccuggggacaccauuaucuucgaagccaacggaaaucucauugcucccauguaugccuuugcgcugagcagaggcuucggguccggaaucauuacaucuaacgccagcaugcacgaguguaauaccaagugccagacgccgcuuggcgcuaucaacuccagccugccuuaccagaauauccaucccguuacaauuggcgaguguccuaaauaugugcggucugccaagcuccgcauggugaccgggcugagaaacauccccuccauucagagccggggacuguuuggcgcuaucgccggguucauugaaggaggcuggacagggaugaucgauggaugguacggcuaucaccaucaaaaugagcagggcucuggguacgccgcugaccagaaaagcacccagaacgcgaucaauggaauuaccaacaaggucaacacagugaucgaaaagaugaauauucaauuuacggccguuggcaaagaguucaacaagcucgaaaaacgcauggagaaucugaacaagaaaguggaugacggguuucuugacaucuggaccuacaaugcugagcugcucguccugcuugaaaacgagagaacacuggauuuccacgacuccaaugugaagaaccucuaugaaaagguuaaaucucagcugaagaauaacgccaaagagauuggaaauggcugcuucgaauuuuaccacaagugugauaacgagugcauggagagcgugcggaaugggaccuaugacuaccccaaauauuccgaagagagcaagcugaaccgcgaaaaggucgauggcgugaaacucgagucuaugggaaucuaccagauccuggccauuuauuccacagucgcuagcucucuugugcugcucguuucccugggcgccaucagcuucuggaugugcuccaaugggucucugcaauguagaauuugcaucuga

SEQ ID NO: 193195 - RNA, 1698 nt, Artificial Sequence
  derived and/or modified sequence opt5 from hemagglutinin__InfluenzaA__AGQ48026
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcaaacucaagggaaucgcuccccugcagcugggcaaauguaacauugccggguggcuccugggaaauccuggcugcgauccgcuucugcccguggggagcugguccuauaucguugagacaccuaacucugaaaauggaauuuguuaccccggcgacuucaucgauuaugaggaacucagagagcaacugagcuccgugucuagcuuugagcgguucaagaucuuuccuaaggaauccagcuggcccgaccauaacaccaauggcgucacagcugccugcucucacgaggggaaaaacuccuucuaccgcaaucuucuguggcucaccaagaaagaaagcucuuauccugagcugaagaacuccuacgugaauaaaaagagaaaggagguucuggugcucuggggcauucaucacccgcccaacagcaaagaacagcagaaccuguaucagaaugagaacgcguacgucucuguggugacguccaauuacaaccggcgcuuuaccccugaaaucgccgagagacccaaggucaaagaucaagcuggacggaugaauuauuacuggacacuucugaagccuggggacaccauuaucuucgaagccaacggaaaucucauugcucccauguaugccuuugcgcugagccgcggcuucggguccggaaucauuacaucuaacgccagcaugcacgaguguaauaccaaaugccagacgccgcuuggcgcuaucaacuccagccugccuuaccagaauauccaucccguuacaauuggcgaguguccuaaguaugugagaucugccaaacuccggauggugaccgggcugcgcaacauccccuccauucagagcagaggacuguuuggcgcuaucgccggguucauugaaggaggcuggacagggaugaucgauggaugguacggcuaucaccaucaaaaugagcagggcucuggguacgccgcugaccagaaaagcacccagaacgcgaucaauggaauuaccaacaaggucaacacagugaucgaaaagaugaauauucaauuuacggccguuggcaaggaguucaacaaacucgaaaagcggauggagaaucugaacaaaaagguggaugacggguuucuugacaucuggaccuacaaugcugagcugcucguccugcuugaaaacgagcgcacacuggauuuccacgacuccaaugugaagaaccucuaugaaaaaguuaagucucagcugaaaaauaacgccaaggagauuggaaauggcugcuucgaauuuuaccacaaaugugauaacgagugcauggagagcgugagaaaugggaccuaugacuaccccaaguauuccgaagagagcaagcugaaccgggaaaaagucgauggcgugaagcucgagucuaugggaaucuaccagauccuggccauuuauuccacagucgcuagcucucuugugcugcucguuucccugggcgccaucagcuucuggaugugcuccaaugggucucugcaaugucgcauuugcaucuga

SEQ ID NO: 193196 - RNA, 1698 nt, Artificial Sequence
  derived and/or modified sequence opt5 from hemagglutinin__InfluenzaA__AGQ48038
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcaaacucaagggaaucgcuccccugcagcugggcaaauguaacauugccggguggcuccugggaaauccuggcugcgauccgcuucugcccguggggagcugguccuauaucguugagacaccuaacucugaaaauggaauuuguuaccccggcgacuucaucgauuaugaggaacucagagagcaacugagcuccgugucuagcuuugagcgguucaagaucuuuccuaaggaauccagcuggcccgaccauaacaccaauggcgucacagcugccugcucucacgaggggaaaaacuccuucuaccgcaaucuucuguggcucaccaagaaagaaagcucuuauccugagcugaagaacuccuacgugaauaaaaagagagaggaaguucuggugcucuggggcauucaucacccgcccaacagcgaggaacagcagaaccuguaucagaaugagaacgcguacgucucuguggugacguccaauuacaaccggcgcuuuaccccugaaaucgccgagagacccaaggucaaaggacaagcugggcggaugaauuauuacuggacacuucugaagccuggagauaccauuaucuucgaggccaacggcaaucucauugcucccauguaugccuuugcgcugagccgcggguucggauccggcaucauuacaucuaacgccagcaugcacgaauguaauaccaaaugccagacgccgcuuggcgcuaucaacuccagccugccuuaccagaauauccaucccguuacaauuggggaguguccuaaguaugugagaucugccaaacuccggauggugaccggacugcgcaacauccccuccauucagagcagaggccuguuuggggcuaucgccggauucauugaaggcggguggacaggaaugaucgacggcugguacggcuaucaccaucaaaaugagcaggggucuggauacgccgcugaucaaaagagcacccagaacgcgaucaauggcauuaccaacaaagucaacacagugaucgaaaagaugaauauucaguuuacggccguugggaaggaguucaacaaacucgagaagcggauggaaaaucugaacaaaaagguggacgauggauuucuugacaucuggaccuacaaugcugagcugcucguccugcuugaaaacgagcgcacacuggacuuccacgauuccaaugugaaaaaccucuaugaaaagguuaagucucagcugaaaaauaacgccaaggagauuggcaaugggugcuucgaguuuuaccacaaaugugacaacgaaugcauggagagcgugagaaauggcaccuaugauuaccccaaguauuccgaagagagcaaacugaaccgggagaaggucgacggagugaagcucgaaucuaugggcaucuaccagauccuggccauuuauuccacagucgcuagcucucuugugcugcucguuucccugggggccaucagcuucuggaugugcuccaauggaucucugcaaugucgcauuugcaucuga

SEQ ID NO: 193197 - RNA, 1698 nt, Artificial Sequence
  derived and/or modified sequence opt5 from hemagglutinin__InfluenzaA__AGQ48050
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcaaacucaagggaaucgcuccccugcagcugggcaaauguaacauugccggguggcuccugggaaauccuggcugcgauccgcuucugcccguggggagcugguccuauaucguugagacaccuaacucugaaaauggaauuuguuaccccggcgacuucaucgauuaugaggaacucagagagcaacugagcuccgugucuagcuuugagcgguucaagaucuuuccuaaggaauccagcuggcccgaccauaacaccaauggcgucacagcugccugcucucacgaggggaaaaacuccuucuaccgcaaucuucuguggcucaccaagaaagaaagcucuuauccugagcugaagaacuccuacgugaauaaaaagagagaggaaguucuggugcucuggggcauucaucacccgcccgauagcgaggaacagcagaaccuguaucagaacgagaaugcguacgucucuguggugacguccaacuacaaucggcgcuuuaccccugaaaucgccgagagacccaaggucaaaggacaagcugggcggaugaacuauuacuggacacuucugaagccuggagacaccauuaucuucaaagccaauggcaaccucauugcucccauguaugccuuugcgcugagccgcggguucggauccggcaucauuacaucuaaugccagcaugcacgaguguaacaccaagugccagacgccgcuuggcgcuaucaauuccagccugccuuaccagaacauccaucccguuacaauuggggaauguccuaaauaugugagaucugccaagcuccggauggugaccggacugcgcaauauccccuccauucagagcagaggccuguuuggggcuaucgccggauucauugagggcggguggacaggaaugaucgauggcugguacggcuaucaccaucaaaacgaacaggggucuggauacgccgcugaccagaaaagcacccagaaugcgaucaacggcauuaccaauaaggucaacacagugaucgagaagaugaacauucaauuuacggccguugggaaagaguucaauaagcucgaaaaacggauggagaaccugaauaagaaaguggaugacggauuucuugacaucuggaccuacaacgcugaacugcucguccugcuugagaaugaacgcacacuggauuuccacgacuccaacgugaagaaucucuaugagaagguuaaaucucagcugaagaacaaugccaaagaaauuggcaacgggugcuucgaguuuuaccacaagugugauaaugagugcauggaaagcgugagaaacggcaccuaugacuaccccaaauauuccgaggaaagcaagcugaaucgggagaaggucgauggagugaaacucgagucuaugggcaucuaccagauccuggccauuuauuccacagucgcuagcucucuugugcugcucguuucccugggggccaucagcuucuggaugugcuccaacggaucucugcaaugucgcauuugcaucuga

SEQ ID NO: 193198 - RNA, 1689 nt, Artificial Sequence
  derived and/or modified sequence opt5 from hemagglutinin__InfluenzaA__AGQ80946
auggccaucauuuaccugauccuccuguucaccgcugugagaggcgaccagauuugcaucggguaucacagcaacaauuccacagagaaggucgauacgauucuugaacggaacguuaccgugacacaugcccaagacauccuggagaaaacccacaauggaaagcucuguaaacugaacggcauucccccucuugaacugggggauugcucuaucgcgggauggcuccugggcaauccggagugugaccgccugcucacagugcccgaauggagcuacaucauggagaaggagaacccuagaaaugggcugugcuaucccggauccuuuaacgauuacgaagaacuuaaacaucugcucucuagcgucacccacuucgaaaaggugaagauucugccuaaagaccgguggacacagcauaccacgaccggcggcucccgcgcuugugccguuucugggaaucccagcuuuuucagaaacaugguguggcuuacaaagaaaggaccuaauuauccggucgccaagggcuccuacaacaauaccagcggggaucagaugcugaucauuuggggagugcaccaccccaacgacgaggcugagcagcggacacucuaucaaaauguuggcaccuacgugucugucgggacguccacacugaacaaacgcagcgugccugaaaucgccaccagacccaaggugaacggacagggcggccggauggaguuuucuuggacaauucuggauguccucgacaccaucaauuucgaauccaccgggaaccugaucgcuccugaguacggauuuaagauuagcaaacgcgggucuuccggcaucaugaagacagaaggaacgcuugagaauugcgagaccaaaugucagacaccccugggcgccauuaacaccacacucccguuccauaauauccacccucugaccauuggggaaugccccaaguauguuaaaagcgagagacuugugcuggcgacgggacuccggaacgugccucagaucgaaucccgcggccuguuuggcgccaucgcuggguucauugagggaggcuggcaagggauggucgauggaugguacggcuaucaucacucuaaugaccaggggagcggcuacgccgcugauaaggaauccacacagaaagccaucgacggaauuaccaacaaggugaauagcguuaucgagaagaugaacacccaguuugaggcggugggcaaagaguucucuaaucuggagaagagacucgaaaaccugaauaaaaagauggaggacggguuucuugaugucuggacauauaacgccgaacugcucgugcugauggagaaugagcggacccuugacuuccacgauuccaacguuaaaaaccuguacgacaaggugcgcaugcaacucagagauaaugcuaaggaacugggaaacggcuguuucgaguuuuaucauaaaugcgacgaugaauguaugaauagcgucaagaacgggacauacgacuaccccaaauaugaggaggaaucuaagcugaaucggaacgagauuaaaggagugaagcucagcaauaugggcgucuaccagauccuggccaucuaugcuacgguggccgggucccuuucucuggccauuaugaucgcuggcauuagccucuggaugugcuccaacggaagccugcagugcagaaucuguauuuga

SEQ ID NO: 193199 - RNA, 1689 nt, Artificial Sequence
  derived and/or modified sequence opt5 from hemagglutinin__InfluenzaA__AGQ80947
auggccaucauuuaccugauccuccuguucgcuaccgugagaggcgaccagauuugcaucggguaucacagcaacaauuccacagagaaggucgauacgauucuugaacggaacaucaccguuacacaugcccaagacauccuggagaaaacccacaauggaaagcucuguaaacugaacggcauucccccucuugaacuggggaauugcucuaucgcgggauggcuccugggcaacccggagugugaucgccugcucacagugcccgaauggagcuacauuauggagaaggagaauccuagagacgggcugugcuaucccggauccuuuaacgauuacgaagaacuuaaacaucugcucucuagcgugacccacuucgaaaaggucaagauccugccuaaagaccgguggacacagcauaccacgaccggcggcucccgcgcuugugccgugucugggaaucccagcuuuuucagaaacaugguuuggcuuacaaagaaaggauccaauuauccuauugccaagggcagcuacaacaauaccucuggggagcagaugcugaucauuuggggagugcaccacccgaacgaugacgcugagcagcggacacucuaucaaaaugucggcaccuacguguccguugggacgagcacacugaacaaacgcucuauccccgaaaucgccaccagaccuaaggugaacggacagggcggccggauggaguuuuccuggacaauucuggauaugcucgacaccaucaauuucgaaagcaccgggaaccugauugcucccgaguacggauuuaagaucucuaaacgcggcuccagcgggauuaugaagacagaaggaacgcuugagaauugcgagaccaaaugucagacaccucugggcgccaucaacaccacacuccccuuccauaauauccacccgcugaccauuggggaaugcccuaaguaugucaaauccgagagacuugugcuggcgacgggacuccggaacgugccccagaucgaaucucgcggccuguuuggcgccauugcuggguucaucgagggaggcuggcaagggauggucgauggaugguacggcuaucaucacagcaaugaccagggguccggcuacgccgcugauaaggaaagcacacagaaagccauugacggaaucaccaacaagguuaauucugugaucgagaagaugaacacccaguuugaggcggugggcaaagaguucaauaaccuggagaagagacucgaaaaucugaacaaaaagauggaggacggguuucuugaugucuggacauauaaugccgaacugcucgugcugauggagaacgagcggacccuugacuuccacgauuccaacguuaaaaaucuguacgacaaggugcgcaugcaacucaaggauaacgcuaaagaacugggaaauggcuguuucgaguuuuaucauaagugcgacgaugaauguaugaacagcgucaaaaaugggacauacgacuacccuaaguaugaggaggaaucuaaacugaacagaaaugagauuaagggagugaagcucagcaacaugggcguuuaccagauccuggccauuuaugcuacgguggccgggucccuuucucuggccaucaugauugcuggcgucagccucuggaugugcuccaauggaagccugcagugccggaucuguauuuga

SEQ ID NO: 193200 - RNA, 1689 nt, Artificial Sequence
  derived and/or modified sequence opt5 from hemagglutinin__InfluenzaA__AGQ80948
auggccaucauuuaccugauccuccuguucgcugccgugagaggcgaccagauuugcaucggguaucacagcaacaauuccaccgagaaggucgauacaauucuugaacggaacguuacggugacccaugcgcaagacauccuggagaaaacacacaauggaaagcucuguaaacugaacggcauucccccucuugaacuggggaauugcucuaucgcuggauggcuccugggcaacccggagugugaucgccugcucaccgugcccgaauggagcuacaucauggagaaggagaauccuagaaacgggcugugcuaucccggauccuuuaaugacuacgaggaacuuaaacaucugcucucuagcgucacacacuucgaaaaggugaagauucugccuaaagaucgguggacccagcauacaaccacgggcggcucccgcgccugugccguuuuugggaaccccucuuucuuuagaaauaugguguggcuuaccaagaaaggaagcaacuauccuaucgcuaagggcuccuacaauaacacaagcggggagcagaugcugauuaucuggggaguccaccacccgaaugacgaugccgagcagcggacccucuaucaaaacgugggcacauacguuucuguggggaccuccacgcugaacaaacgcagcauucccgaaaucgcuacaagaccuaaggucaauggacagggcggccggauggaguucucuuggaccauccuggacaugcucgauacaauuaacuuugaauccaccgggaaucugaucgcccccgaguacggauucaagauuagcaaacgcgggucuuccggcaucaugaagaccgaaggaacacuugagaacugcgagacgaaaugucagaccccucugggcgcgauuaauacaacccuccccuuucauaacauccacccgcugacaaucggggaaugcccuaaguaugugaaaagcgagagacuugugcuggccaccggacuccggaaugucccccagauugaaucccgcggccuguucggcgcuaucgccggguuuauugagggaggcuggcaagggaugguugacggaugguacggcuaucaucacucuaacgaucaggggagcggcuacgcugccgacaaggaauccacgcagaaagcgaucgauggaauuacaaauaaggugaacagcgugaucgagaagaugaauacccaguucgaggccgucggcaaagaauuuaacaaucuggagaagagacucgaaaaccugaauaaaaagauggaggacggguuccuugacguguggaccuauaacgcugaacugcucguucugauggagaacgagcggacacuugauuuccacgacucuaaugugaaaaaccuguacgauaagauccgcaugcaacucaaggacaaugccaaagaacugggaaacggcuguuuugaguucuaucauaagugcgaugacgaauguaugaacuccgucaaaaaugggaccuacgauuacccuaaguaugaggaggaaagcaaacugaauagaaacgagauuaagggagugaagcucucuaauaugggcguuuaccagauccuggcuauuuaugccacaguggccgggagccuuucccuggcuaucaugauugcgggcaucucucucuggaugugcagcaacggaucccugcagugccggauuuguaucuga

SEQ ID NO: 193201 - RNA, 1689 nt, Artificial Sequence
  derived and/or modified sequence opt5 from hemagglutinin__InfluenzaA__AGQ80949
auggccaucauuuaccugauccuccuguucgcugccgugagaggcgaccagauuugcaucggguaucacagcaacaauuccaccgagaaggucgauacaauucuugaacggaacguuacggugacccaugcgcaagacauccuggagaaaacacacaauggaaagcucuguaaacugaacggcauucccccucuugaacugggggauugcucuaucgcuggauggcuccugggcaauccggagugugaccgccugcucaccgugcccgaauggagcuacaucauggagaaggagaacccuagaaaugggcugugcuaucccggauccuuuaacgauuacgaagaacuuaaacaucugcucucuagcgucacacacuucgaaaaggugaagauucugccuaaagaccgguggacccagcauacaaccacgggcggcucccgcgccugugccguuucugggaaucccagcuuuuucagaaacaugguguggcuuaccaagaaaggauccaauuauccuaucgcuaagggcagcuacaacaauacaucuggggagcagaugcugauuaucuggggaguccaccacccgaacgaugacgccgagcagcggacccucuaucaaaaugugggcacauacguuuccguggggaccagcacgcugaacaaacgcucuauucccgaaaucgcuacaagaccuaaggucaacggacagggcggccggauggaguuuuccuggaccauccuggauaugcucgacacaauuaauuucgaaagcaccgggaaccugaucgcccccgaguacggauuuaagauuucuaaacgcggcuccagcgggaucaugaagaccgaaggaacacuugagaauugcgagacgaaaugucagaccccucugggcgcgauuaacacaacccuccccuuccauaauauccacccgcugacaaucggggaaugcccuaaguaugugaaauccgagagacuugugcuggccaccggacuccggaacgucccccagauugaaucucgcggccuguuuggcgcuaucgccggguucauugagggaggcuggcaagggaugguugauggaugguacggcuaucaucacagcaaugaccagggguccggcuacgcugccgauaaggaaagcacgcagaaagcgaucgacggaauuacaaacaaggucaauucugugaucgagaagaugaacacccaguuugaggccgugggcaaagaguucaauaaccuggagaagagacucgaaaaucugaacaaaaagauggaggacggguuucuugauguguggaccuauaaugcugaacugcucguucugauggagaacgagcggacacuugacuuccacgauuccaacgugaaaaaucuguacgacaagauccgcaugcaacucaaggauaacgccaaagaacugggaaauggcuguuucgaguuuuaucauaagugcgacgaugaauguaugaacagcgucaaaaaugggaccuacgacuacccuaaguaugaggaggaaucuaaacugaacagaaaugagauuaagggagugaagcucagcaacaugggcguuuaccagauccuggcuauuuaugccacaguggccgggucccuuucucuggcuaucaugauugcgggcaucagccucuggaugugcuccaauggaagccugcagugccggauuuguaucuga

SEQ ID NO: 193202 - RNA, 1701 nt, Artificial Sequence
  derived and/or modified sequence opt5 from hemagglutinin__InfluenzaA__AGQ80950
augaagaccaucauugcccugagcuacaucuucugccucgcuuuuggccagaaccugcccgggaaugacuccucuacagccacgcuuugucugggacaccaugcggugcucaacggcaccauugucaaaacaaucaccgaugaccaaauugagguuacaaaugcuaccgaacuggugcagagcuccucuacagggaagaucugcaacaauccucacaaaauccuugauggaagagacuguacccugauugaugcccuccugggcgacccgcauugcgauguguuccaggacgagacgugggaucuguuugucgaacggagcuccgccuucucuaacuguuaucccuacgacgugccugauuaugcuagccuccgcucccugguugccagcucugggacccuugaguuuaucacagaaggauucaccuggacaggcgugucccagaauggcgggagcggagcuugcaagagaggccccgccaacggguuuuucucucggcugaauuggcucaccaaauccggaaacgcguacccuguccugaaugugacgaugcccaacagcgacaauuuugauaaacuuuauauuuggggcguucaccauccuucuacaaaccaagagcagaccaaucuguacgugcaggccuccgggcgcgucacagugagcaccagacggucccagcaaaccaucauuccgaacaucggaucucgccccugggugagaggccagagcggccggauuuccaucuauuggacaaucgucaagccuggggacguucucgugauuaacagcaauggaaaccugaucgcuccccgcggcuacuucaaaaugagaacggggaagucuuccauuaugcggagcgacgccccuaucgagaccuguauuucugaaugcaucacacccaauggaagcaucccgaacgauaaaccuuuucagaaugugaacaagauuaccuacggcgcuugucccaaauaugucaagcagaauacacugaagcucgccaccgggaugcgcaacgugccugagaaacaaacgagaggacuguucggcgcgaucgccggcuuuauugaaaaugggugggagggaaugaucgacggcugguacggguuccggcaccagaacuccgagggaacaggccaggcugccgaucuuaagucuacccaagcugccauugaccagaucaaugggaaacugaaccgcguuaucgaaaagaccaaugagaaauuccaccagauugaaaaggaguuuagcgaaguggagggcagaauccaggaucucgagaaauaugucgaagacacaaagauugaucugugguccuacaacgccgagcuucugguggcucucgaaaaucaacauaccaucgaccugacagauagcgagaugaacaagcuguucgaaaagacgcggagacagcuccgcgagaacgcggaggacaugggaaauggcugcuuuaagauuuaucacaaaugugauaacgccugcaucgaaucuauucggaaugggaccuacgaccaugacaucuauagagaugaggcucugaacaaucgcuuccagaucaagggaguugaacuuaaauccggcuacaaggacuggauucuguggaucagcuuugccauuucuugcuuccuccugugugugguccuucugggguuuaucaugugggccugccagcggggaaacauuagauguaauaucugcaucuga

SEQ ID NO: 193203 - RNA, 1695 nt, Artificial Sequence
  derived and/or modified sequence opt5 from hemagglutinin__InfluenzaA__AGQ80951
augcugagcaucgugauucucuuccugcuugucgccgaguccucuagccagaacuacaccggcaaucccguuaucugcauggggcaccaugcuguggccaacggaacaauggugaagacgcugaccgacgaucaagucgaagugguuacagcgcaggagcucguggaaucccagaaucugccugagcuuuguccgucuccccugagacucgucgacggccagaccugcgauauuaucaacggggcucugggaagcccuggcugugaccaccugaauggggccgaaugggauauuuuuaucgagcggcccaacgccauggacacaugcuauccuuucgaugugcccgacuaccaaucccuccgcucuauccuggcuaauaacggaaaauuugaguucauugccgaagaguuucaguggagcaccguuaagcagaauggcaaauccggcgcuuguaagagagccaacgugaaugauuucuuuaaccggcuuaauuggcuggucaaaagcgacgggaacgcguauccucuccagaaucugacaaaggugaacaacggagauuacgcccgccuuuauaucuggggcgugcaucacccgucuaccgacacggaacaaaccaaucuguacaagaacaaucccgggagagucacaguuuccaccaaaacaagccagaccucuguggugccuaacauuggaucccggcccuggguccgcggccagagcgggagaaucucuuucuauuggacgauuguggagccuggagaucucaucguuuuuaauacaauuggcaaccugaucgcuccccggggccauuacaagcucaauucccagaaaaagagcaccauccugaacacagccaccccgauuggguccugcgugucuaaaugucacaccgacaagggaagccuguccacaacgaagccuuuccaaaauaucagccgcgucgcuauuggcgacugccccaaauacgugaagcaggggucucuuaaacuggccaccggaaugagaaacaucccugagaaggcgucccggggccucuuuggggccauugcuggauucaucgaaaauggcuggcagggccugaucgaugggugguauggauuucgccaccaaaacgccgagggcacagggaccgcugccgaccuuaaaagcacacaggccgcuauugaucagaucaauggaaagcugaacagacucauugagaaaaccaaugaaaaguaccaucagaucgaaaaggaguucgagcaaguugaaggccggauucaggaccuggagaaauauguggaagauacgaagaucgaccuguggucuuacaacgcggagcuccuggucgcccuugaaaaccagcacacaaucgaugugaccgacagcgagaugaauaaacuguucgagcgcgucagacggcagcucagagaaaacgcugaggauaaggggaauggcuguuuugaaauuuuccauaaaugcgacaacaauuguaucgaguccauucgcaacggaaccuaugaucacgacguguaccggaaugaagccaucaacaauagauuucaaauucagggcguuaagcugacacagggguauaaggacaucauucuuuggaucucuuucagcaucuccugcuuucugcucguggcccugcugcucgcuuucauucugugggccugccagaacggaaauauccgcugucaaauuugcaucuga

SEQ ID NO: 193204 - RNA, 1683 nt, Artificial Sequence
  derived and/or modified sequence opt5 from hemagglutinin__InfluenzaA__AGQ80953
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaagagccguggaucuggggcaaugcggacuccugggcacaaucaccgggccgccccagugugaccaguuucuugaguucagcgccgaucugaucauugaacggcgcgagggauccgacgucugcuacccuggcaaguuugugaaugaggaagcucucagacagauccugcgggagucuggcgggauugauaaagaaacgaugggauucaccuauagcggcauccgcacaaacggggccaccuccgcuuguagacggucuggaagcuccuuuuacgccgagaugaaguggcugcucagcaauacagacaacgcggccuucccccaaaccacgaagucuuauaaaaauacacgcaaggauccugcucugauuaucuggggcauucaccauuccgggagcaccacagagcagaccaaacuuuacggaucuggcaacaagcugaucaccguuggcuccagcaauuaucagcagucuuuugugcccuccccuggggccagaccgcaagucaacggacagagcggccggaucgacuuccacuggcucaugcugaaucccaacgauacagugacguuuuccuucaauggggcuuuuauugccccugaccgcgcgucuuuccuuagaggaaaaagcaugggcauccaguccggggugcaggucgaugccaacugcgaaggagacuguuaccauaacggcggcaccauuaucagcaaucugcccuuucaaaacauuaauucucgggcuguugggaagugcccucgcuaugugaagcaggagucccuccugcuggccacaggaaugaaaaacgugcccgaaaucccgaagggcagagggcuuuucggagcuaucgccggcuucauugagaaugggugggaaggccugaucgauggaugguacggcuuucggcaccagaacgcccaaggggagggaaccgcugcggacuacaaaagcacacagucugccauugaccagaucaccggcaagcucaauagacugauugagaaaacgaaccagcaauucgaacucaucgauaaugaguuuacagaagucgagcgccagaucgggaacgugauuaauuggacccgggacagcaugaccgaaguuugguccuauaacgcugagcugcuuguggccauggagaaucagcacacaaucgaucuggccgacucugaaaugaacaagcucuacgagagaguccgccggcagcugagagaaaaugcugaggaagauggaaccggcuguuucgagauuuuucauaaaugcgacgaugacuguauggccagcauccgcaacaacacauaugaucacuccaaguaccgggaggaagcgaugcaaaaucgcauucagaucgacccugugaagcugagcucuggguauaaagauguuauucucugguucuccuuuggcgcuagcugcuucauccugcuugccaucgccaugggacugguguuuauuugcgucaagaacggcaauaugagauguacgaucugcauuuga

SEQ ID NO: 193205 - RNA, 1683 nt, Artificial Sequence; identical to SEQ ID NO: 193204
  derived and/or modified sequence opt5 from hemagglutinin__InfluenzaA__AGQ80954

SEQ ID NO: 193206 - RNA, 1683 nt, Artificial Sequence; identical to SEQ ID NO: 193204
  derived and/or modified sequence opt5 from hemagglutinin__InfluenzaA__AGQ80955

SEQ ID NO: 193207 - RNA, 1683 nt, Artificial Sequence; identical to SEQ ID NO: 193204
  derived and/or modified sequence opt5 from hemagglutinin__InfluenzaA__AGQ80956

SEQ ID NO: 193208 - RNA, 1683 nt, Artificial Sequence; identical to SEQ ID NO: 193204
  derived and/or modified sequence opt5 from hemagglutinin__InfluenzaA__AGQ80957

SEQ ID NO: 193209 - RNA, 1683 nt, Artificial Sequence; identical to SEQ ID NO: 193204
  derived and/or modified sequence opt5 from hemagglutinin__InfluenzaA__AGQ80958

SEQ ID NO: 193210 - RNA, 1683 nt, Artificial Sequence
  derived and/or modified sequence opt5 from hemagglutinin__InfluenzaA__AGQ80959
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaaggauccugcucugaucauuuggggcauccaccauucuggguccacagccgagcagaccaaacuuuacggaagcggcaauaagcuggugacaguugggucuuccaacuaucagcagagcuuugugcccucuccuggcgcuagaccgcaagucaauggacaguccggccggaucgacuuccacuggcucaugcugaaccccaaugauaccgugaccuuuagcuucaacggggccuuuauugcgccugaccgcgccuccuuccuuagaggaaaaucuaugggcauccagagcggggugcaggucgaugcuaacugcgaaggagacuguuaccauggcggcgggacaauuaucuccaaucugcccuuucaaaacauugauagccgggccguuggaaagugcccucgcuaugugaagcagaaaucucuccugcuggcuacgggcaugaagaaugugcccgaguccccgaaagggagaggacucuucggcgccaucgccggguucaucgaaaacggcugggagggacugauugacggcugguacggguuucggcaccagaaugcucaaggagaaggcaccgcggccgacuacaagagcacacagucugcuaucgaucagauuaccgggaaacuuaacagacugaucgagaagacaaaucagcaauucgagcucauugacaacgaauuuaccgaggucgaaaaacagaucggaaaugugaucaacuggacgcgcgauagcauuacagagguuugguccuauaaugccgaacugcuuguggccauggagaaccagcacaccaucgaccuggcugauucugagaugaauaagcucuacgaacgggucaagagacagcugcgcgagaacgccgaagaggacggcaccggguguuucgaaauuuuucauaaaugcgaugacgauuguauggcgagcauccggaauaacacauaugaccacuccaaguacagagaggaggcuaugcaaaaccgcauucagaucgauccugugaaacugagcucuggcuauaaggacguuauucucugguucuccuuuggagccagcugcuucauccugcuugccaucgcuaugggccugguguuuauuugcgucaaaaaugggaacaugcgguguaccaucugcauuuga

SEQ ID NO: 193211 - RNA, 1683 nt, Artificial Sequence
  derived and/or modified sequence opt5 from hemagglutinin__InfluenzaA__AGQ80961
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccaaugugccuaagaucuguuccaaaggcaagcgcacagucgaucuggggcaaugcggacuccugggcaccauuacggggccgccccagugugaccaguuucuugaguucucugccgaucugaucaucgaaagacgggagggaagcgacgugugcuacccuggcaaauuuguuaacgaggaaacccuccgccagauucugagagaguccggcgggaucgauaaggaaacaaugggauucaccuauucuggcauucggacaaauggggccaccagcgcuugucgcagauccggaucuagcuuuuacgccgagaugaaguggcugcucuccaacacggacaaugcugccuucccccaaaugacaaaaagcuauaagaacgcgcggaaagauccugcccugaucauuuggggcauccaccauucuggguccaccacagagcagaccaaacuuuacggaagcggcaauaagcugauuaccguggggucuuccaacuaucagcagagcuuuguccccucuccuggcgcucgcccgcaagugaauggacaguccggcagaaucgacuuccacuggcucaugcugaaccccaaugauacagugacguuuagcuucaacggggccuuuaucgcuccugaccgggccugcuuccuucgcggaaaguccaugggcauucagucugggguccagguugaugcgagcugugaaggagacugcuaccauuccggcggcaccaucauuagcaaccugcccuuucaaaauaucaacucuagagccguggggaaguguccucgguaugugaaacaggagucccucaugcuggcuacaggaaugaagaauguccccgaaauuccgaaaggccgcgggcuguucggagccaucgcuggcuucaucgagaacgggugggaaggccucauugauggaugguacggcuuuagacaccagaaugcccaaggggagggaaccgccgcugacuacaagagcacacagucugcgaucgaccagauuaccggcaaacugaaccggcuuaucgagaagacgaaucagcaauucgaacugauugauaacgaguuuacagaaguggagaaacagaucgggaauguuaucaacuggaccagagacagcaugaccgaagugugguccuauaaugccgagcuccuggucgcuauggagaaccagcacacaauugaucuugccgacucugaaaugaauaagcuguacgagcgcgugaagcggcagcucagagaaaacgccgaggaagauggaaccggcugcuucgagaucuuucauaaaugugacgaugacugcauggcuagcauucgcaauaacacauaugaucacuccaaguaccgggaggaagccaugcaaaacagaaucaaaauugacccuguuaagcugagcucuggguauaaagaugugauccugugguucuccuuuggcgcgagcugcuucauucuccuggcuaucgccaugggacuugucuuuaucugugugaagaauggcaacaugcgcugcacgauuuguaucuga

SEQ ID NO: 193212 - RNA, 1683 nt, Artificial Sequence; identical to SEQ ID NO: 193211
  derived and/or modified sequence opt5 from hemagglutinin__InfluenzaA__AGQ80962

SEQ ID NO: 193213 - RNA, 1683 nt, Artificial Sequence
  derived and/or modified sequence opt5 from hemagglutinin__InfluenzaA__AGQ80964
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaaggauccugcucugaucauuuggggcauccaccauucuggguccacagccgagcagaccaaacuuuacggaagcggcaauaagcuggugacaguugggucuuccaacuaucagcagagcuuugugcccucuccuggggcuagaccgcaagucaauggacaguccggccggaucgacuuccacuggcucaugcugaaccccaaugauaccgugaccuuuagcuucaacggggccuuuauugcgccugaccgcgccuccuuccuuagaggaaaaucuaugggcauccagagcggggugcaggucgaugcugacugcgaaggagauuguuaccauuccggcggcacaauuaucagcaaccugcccuuucaaaauauugacucucgggccguugggaagugcccucgcuaugugaagcagagaucccuccugcuggcuacgggaaugaaaaacgugcccgagaucccgaagggccggggccucuucggagccaucgccggcuucauugaaaaugggugggagggccugaucgacggaugguacggcuuuagacaccagaacgcucaaggggaaggaaccgcggccgauuacaaaagcacacagucugcuauugaccagaucaccggcaaacuuaaucgccugauugagaagacaaaccagcaauucgagcucaucgauaaugaauuuaccgaggucgaaaagcagaucgggaacgugauuaauuggacgcgggacagcaucacagagguuugguccuauaacgccgaacugcuuguggccauggagaaucagcacaccauugaucuggcugacucugagaugaacaaacucuacgaaagagucaagcgccagcugcgggagaaugccgaagaggauggaaccggcuguuucgaaaucuuucauaagugcgacgaugacuguauggcgagcauuagaaacaauacauaugaucacuccaaauaccgcgaggaggcuaugcaaaaccggauccagauugacccugugaagcugagcucuggguauaaagacguuauccucugguucuccuuuggcgccagcugcuucauccugcuugccauugcuaugggacugguguuuaucugcgucaagaacggcaauaugagauguaccauuugcaucuga

SEQ ID NO: 193214 - RNA, 1683 nt, Artificial Sequence; identical to SEQ ID NO: 193204
  derived and/or modified sequence opt5 from hemagglutinin__InfluenzaA__AGQ80965

SEQ ID NO: 193215 - RNA, 1683 nt, Artificial Sequence; identical to SEQ ID NO: 193204
  derived and/or modified sequence opt5 from hemagglutinin__InfluenzaA__AGQ80966

SEQ ID NO: 193216 - RNA, 1683 nt, Artificial Sequence; identical to SEQ ID NO: 193204
  derived and/or modified sequence opt5 from hemagglutinin__InfluenzaA__AGQ80968

SEQ ID NO: 193217 - RNA, 1683 nt, Artificial Sequence
  derived and/or modified sequence opt5 from hemagglutinin__InfluenzaA__AGQ80970
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaaaggccguggaucuggggcaaugcggacuccugggcacaaucaccgggccgccccagugugaccaguuucuugaguucagcgccgaucugaucauugaaagacgggagggauccgacgucugcuacccuggcaaauuugugaaugaggaagcucuccgccagauccugagagagucuggcgggauugauaaggaaacgaugggauucaccuauagcggcauccggacaaacggggccaccuccgcuugucgcagaucuggaagcuccuuuuacgccgagaugaaguggcugcucagcaauacagacaacgcggccuucccccaaaccacgaaaucuuauaagaauacacggaaagauccugcucugauuaucuggggcauucaccauuccgggagcaccacagagcagaccaagcucuacggaucuggcaacaaacugaucaccguuggcuccagcaauuaucagcagucuuuugugcccuccccuggggcccgcccgcaagucaacggacagagcggcagaaucgacuuccacuggcucaugcugaaucccaacgauacagugacguuuuccuucaauggggcuuuuauugccccugaccgggcgucuuuccuucgcggaaagagcaugggcauccaguccggggugcaggucgaugccaacugcgaaggagacuguuaccauaacggcggcaccauuaucagcaaucugcccuuucaaaacauuaauucuagagcuguugggaagugcccucgguaugugaaacaggagucccuccugcuggccacaggaaugaagaacgugcccgaaaucccgaaaggccgcgggcuuuucggagcuaucgccggcuucauugagaaugggugggaaggccugaucgauggaugguacggcuuuagacaccagaacgcccaaggggagggaaccgcugcggacuacaagagcacacagucugccauugaccagaucaccggcaaacuuaaucggcugauugagaagacgaaccagcaauucgaacucaucgauaaugaguuuacagaagucgagagacagaucgggaacgugauuaauuggacccgcgacagcaugaccgaaguuugguccuauaacgcugagcugcuuguggccauggagaaucagcacacaaucgaucuggccgacucugaaaugaacaaacucuacgagcgggucagacgccagcugcgggaaaaugcugaggaagauggaaccggcuguuucgagauuuuucauaagugcgacgaugacuguauggccagcaucagaaacaacacauaugaucacuccaaguaccgcgaggaagcgaugcaaaaucggauucagaucgacccugugaaacugagcucuggguauaaggauguuauucucugguucuccuuuggcgcuagcugcuucauccugcuugccaucgccaugggacugguguuuauuugcgucaaaaacggcaauaugagauguacgaucugcauuuga

SEQ ID NO: 193218 - RNA, 1683 nt, Artificial Sequence
  derived and/or modified sequence opt5 from hemagglutinin__InfluenzaA__AGQ80971
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaaagacaguggaucuggggcaaugcggacuccugggcaccaucacggggccgccccagugugaccaguuucuugaguucagcgccgaucugaucauugaaagacgggagggauccgacgucugcuacccuggcaaauuugugaaugaggaagcccuccgccagauccugagagagucuggcgggauugauaaggaaaccaugggauucacauauagcggcauccggaccaacggggcuacauccgccugucgcagaucuggaagcuccuuuuacgcugagaugaaguggcugcucagcaauaccgacaacgccgcguucccccaaacgacaaaaucuuauaagaauacccggaaagauccugcccugauuaucuggggcauucaccauuccgggagcacaaccgagcagaccaagcucuacggaucuggcaacaaacugaucacaguuggcuccagcaauuaucagcagucuuuugugcccuccccuggggcucgcccgcaagucaacggacagagcggcagaaucgacuuccacuggcucaugcugaaucccaacgauacggugaccuuuuccuucaauggggccuuuauugcuccugaccgggccucuuuccuucgcggaaagagcaugggcauccaguccggggugcaggucgaugcgaacugcgaaggagacuguuaccauaacggcggcacaauuaucagcaaucugcccuuucaaaacauuaauucuagagccguugggaagugcccucgguaugugaaacaggagucccuccugcuggcuaccggaaugaagaacgugcccgaaaucccgaaaggccgcgggcuuuucggagccaucgcuggcuucauugagaaugggugggaaggccugaucgauggaugguacggcuuuagacaccagaacgcccaaggggagggaacagccgcugacuacaagagcacccagucugcgauugaccagaucacgggcaaacuuaaucggcugauugagaagacaaaccagcaauucgaacucaucgauaaugaguuuaccgaagucgagagacagaucgggaacgugauuaauuggacccgcgacagcaugacagaaguuugguccuauaacgccgagcugcuuguggcuauggagaaucagcacaccaucgaucuggccgacucugaaaugaacaaacucuacgagcgggucagacgccagcugcgggaaaaugccgaggaagauggaacaggcuguuucgagauuuuucauaagugcgacgaugacuguauggcuagcaucagaaacaacacguaugaucacuccaaguaccgcgaggaagccaugcaaaaucggauucagaucgacccugugaaacugagcucuggguauaaggauguuauucucugguucuccuuuggcgcgagcugcuucauccugcuugcuaucgccaugggacugguguuuauuugcgucaaaaacggcaauaugagauguaccaucugcauuuga

SEQ ID NO: 193219 - RNA, 1683 nt, Artificial Sequence
  derived and/or modified sequence opt5 from hemagglutinin__InfluenzaA__AGQ80974
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaagagccguggaucuggggcaaugcggacuccugggcacaaucaccgggccgccccagugugaccaguuucuugaguucagcgccgaucugaucauugaacggcgcgagggauccgacgucugcuacccuggcaaguuugugaaugaggaagcucucagacagauccugcgggagucuggcgggauugauaaagaaacgaugggauucaccuauagcggcauccgcacaaacggggccaccuccgcuuguagacggucuggaagcuccuuuuacgccgagaugaaguggcugcucagcaauacagacaacgcggccuucccccaaaccacgaagucuuauaaaaauacacgcaaggauccugcucugauuaucuggggcauucaccauuccgggagcaccacagagcagaccaaacuuuacggaucuggcaacaagcugaucaccguuggcuccagcaauuaucagcagucuuuugugcccuccccuggggccagaccgcaagucaacggacagagcggccggaucgacuuccacuggcucaugcugaaucccaacgauacagugacguuuuccuucaauggggcuuuuauugccccugaccgcgcgucuuuccuuagaggaaaaagcaugggcauccaguccggggugcaggucgaugccaacugcgaaggagacuguuaccauaacggcggcaccauuaucagcaaucugcccuuucaaaacauuaauucucgggcuguugggaagugcccucgcuaugugaagcaggagucccuccugcuggccacaggaaugaaaaacgugcccgaaaucccgaagggcagagggcuuuucggagcuaucgccggcuucauugagaaugggugggaaggccuggucgauggaugguacggcuuucggcaccagaacgcccaaggggagggaaccgcugcggacuacaaaagcacacagucugccaucgaccagauuaccggcaagcucaauagacugaucgagaaaacgaaccagcaauucgaacucauugauaaugaguuuacagaaguggagcgccagaucgggaacguuaucaauuggacccgggacagcaugaccgaagugugguccuauaacgcugagcugcuugucgccauggagaaucagcacacaauugaucuggccgacucugaaaugaacaagcucuacgagagagugcgccggcagcugagagaaaaugcugaggaagauggaaccggcuguuucgagaucuuucauaaaugcgacgaugacuguauggccagcauucgcaacaacacauaugaucacuccaaguaccgggaggaagcgaugcaaaauagaauccagauugacccuguuaagcugagcucuggguauaaagaugugauccucugguucuccuuuggcgcuagcugcuucauucugcuugccaucgccaugggacuggucuuuaucugcgugaagaacggcaauaugcgcuguacgauuugcaucuga

SEQ ID NO: 193220 - RNA, 1683 nt, Artificial Sequence
  derived and/or modified sequence opt5 from hemagglutinin__InfluenzaA__AGQ80977
augaacacccagauccuggcccucgcucuggccgcgauuauccccacaaaugcugacaagauuugccuuggccaccaugccgugagcaacgggacgaaagucaauacccugacagagagaggaguugaaguggugaacgccaccgagacagucgaacggaccuccaucccucgcauuuguucuaagggcaaaagagcuguggaucucgggcaaugcggacugcuuggcacaaucaccgggccgccccagugugaccaguuccuggaguuuagcgccgaucucaucauugaacggcgcgagggauccgacguuugcuacccuggcaaguucgugaaugaggaagcucugagacagauccugcgggagucuggcgggauugauaaagaaacgaugggauuuaccuauagcggcauccgcacaaacggggccaccuccgcguguagacggucuggaagcuccuucuacgccgagaugaaguggcuccugagcaauacagacaacgcugccuuuccccaaaccacgaagucuuauaaaaauacacgcaaggauccugcucuuauuaucuggggcguccaccauuccgggagcaccacagagcagaccaaacuguacggaucuggcaacaagcucauuaccgugggcuccagcaauuaucagcagucuuucguucccuccccuggggccagaccgcaagugaacggacagagcggccggaucgacuuucacuggcugaugcuuaaucccaacgauacagucacguucuccuuuaauggggcguucaucgccccugaccgcgcuucuuuucugagaggaaaaagcaugggcauucaguccgggguccagguggaugccaacugcgaaggagacuguuaccauaacggcggcaccaucauuagcaaucuccccuuccaaaacaucaauucucgggcuguggggaagugcccucgcuauguuaagcaggagucccugcugcucgccacaggaaugaaaaacgugcccgaaauuccgaagggcagagggcuguuuggagccaucgcuggcuucaucgagaaugggugggaaggccuuguggauggaugguacggcuuccggcaccagaacgcgcaaggggagggaaccgccgcugacuacaaaagcacacagucugccauugaccagaucaccggcaagcugaauagacucauugagaaaacgaaccagcaauuugaacugaucgauaaugaguucacagaagucgagcgccagauugggaacgugaucaauuggacccgggacagcaugaccgaaguuugguccuauaacgccgagcuucugguggcuauggagaaucagcacacaaucgaucucgccgacucugaaaugaacaagcuguacgagagaguccgccggcagcugagagaaaaugcggaggaagauggaaccggcuguuuugagauuuuccauaaaugcgacgaugacuguauggcuagcauccgcaacaacacauaugaucacuccaaguaccgggaggaagccaugcaaaaucgcauucagaucgacccugugaagcucagcucuggguauaaagauguuauucugugguuuuccuucggcgccagcugcuuuauccuucuggcuauugccaugggacucguguucaucugcgucaagucuggcaacaugagauguacgaucugcauuuga

SEQ ID NO: 193221 - RNA, 1683 nt, Artificial Sequence
  derived and/or modified sequence opt5 from hemagglutinin__InfluenzaA__AGQ80978
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaagagccguggaucuggggcaaugcggacuccugggcacaaucaccgggccgccccagugugaccaguuucuugaguucagcgccgaucugaucauugaacggcgcgagggauccgacgucugcuacccuggcaaguuugugaaugaggaagcucucagacagauccugcgggagucuggcgggauugauaaagaaacgaugggauucaccuauagcggcauccgcacaaacggggccaccuccgcuuguagacggucuggaagcuccuuuuacgccgagaugaaguggcugcucagcaauacagacaacgcggccuucccccaaaccacgaagucuuauaaaaauacacgcaaggauccugcucugauuaucuggggcauucaccauuccgggagcaucaccgagcagacaaaacuuuacggaucuggcaacaagcugaucaccguuggcuccagcaauuaucagcagucuuuugugcccuccccuggggccagaccgcaagucaacggacagagcggccggauugacuuccacuggcucaugcugaaucccaacgauaccgugacauuuuccuucaauggggcuuuuaucgccccugaccgcgcgucuuuccuuagaggaaaaagcaugggcauucaguccggggugcaggucgaugccaacugcgaaggagacuguuaccauaacggcggcacgaucauuagcaaucugcccuuucaaaacaucaauucucgggcuguugggaagugcccucgcuaugugaagcaggagucccuccugcuggccaccggaaugaaaaacgugcccgaaaucccgaagggcagagggcuuuucggagcuauugccggcuucaucgagaaugggugggaaggccuggucgauggaugguacggcuuucggcaccagaacgcccaaggggagggaacagcugcggacuacaaaagcacccagucugccauugaccagaucacaggcaagcucaauagacugauugagaaaaccaaccagcaauucgaacucaucgauaaugaguuuacggaaguggagcgccagaucgggaacguuauuaauuggacacgggacagcaugaccgaagugugguccuauaacgcugagcugcuugucgccauggagaaucagcacaccaucgaucuggccgacucugaaaugaacaagcucuacgagagagugcgccggcagcugagagaaaaugcugaggaagauggaacaggcuguuucgagauuuuucauaaaugcgacgaugacuguauggccagcauccgcaacaacaccuaugaucacuccaaguaccgggaggaagcgaugcaaaaucgcauucagaucgacccuguuaagcugagcucuggguauaaagaugugauucucugguucuccuuuggcgcuagcugcuucauccugcuugccaucgccaugggacuggucuuuauuugcgugaagaacggcaauaugagauguacaaucugcauuuga

SEQ ID NO: 193222 - RNA, 1683 nt, Artificial Sequence
  derived and/or modified sequence opt5 from hemagglutinin__InfluenzaA__AGQ80979
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaagagccguggaucuggggcaaugcggacuccugggcacaaucaccgggccgccccagugugaccaguuucuugaguucagcgccgaucugaucauugaacggcgcgagggauccgacgucugcuacccuggcaaguuugugaaugaggaagcucucagacagauccugcgggagucuggcgggauugauaaagaaacgaugggauucaccuauagcggcauccgcacaaacggggccaccuccgcuuguagacggucuggaagcuccuuuuacgccgagaugaaguggcugcucagcaauacagacaacgcggccuucccccaaaccacgaagucuuauaaaaauacacgcaaggauccugcucugauuaucuggggcauucaccauuccgggagcaccacagagcagaccaaacuuuacggaucuggcaacaagcugaucaccguuggcuccagcaauuaucagcagucuuuugugcccuccccuggggccagaccgcaagucaacggacagagcggccggaucgacuuccacuggcucaugcugaaucccaacgauacagugacguuuuccuucaauggggcuuuuauugccccugaccgcgcgucuuuccuuagaggaaaaagcaucggcauucaguccggggugcaggucgaugccaacugcgaaggagacuguuaccauaacggcggcaccaucauuagcaaucugcccuuucaaaacaucaauucucgggcuguugggaagugcccucgcuaugugaagcaggagucccuccugcuggccacaggaaugaaaaacgugcccgaaaucccgaagggcagagggcuuuucggagcuauugccggcuucaucgagaaugggugggaaggccugauugauggaugguacggcuuucggcaccagaacgcccaaggggagggaaccgcugcggacuacaaaagcacacagucugccaucgaccagauuaccggcaagcucaauagacugaucgagaaaacgaaccagcaauucgaacucaucgauaaugaguuuacagaagucgagcgccagauugggaacgugaucaauuggacccgggacagcaugaccgaaguuugguccuauaacgcugagcugcuuguggccauggagaaucagcacacaauugaucuggccgacucugaaaugaacaagcucuacgagagaguccgccggcagcugagagaaaaugcugaggaagauggaaccggcuguuucgagaucuuucauaaaugcgacgaugacuguauggccagcauucgcaacaacacauaugaucacuccaaguaccgggaggaagcgaugcaaaauagaauccagauugacccugugaagcugagcucuggguauaaagauguuauccucugguucuccuuuggcgcuagcugcuucauccugcuugccauugccaugggacugguguuuaucugcgucaagaacggcaauaugcgcuguacgauuugcaucuga

SEQ ID NO: 193223 - RNA, 1683 nt, Artificial Sequence; identical to SEQ ID NO: 193219
  derived and/or modified sequence opt5 from hemagglutinin__InfluenzaA__AGQ80980

SEQ ID NO: 193224 - RNA, 1683 nt, Artificial Sequence; identical to SEQ ID NO: 193204
  derived and/or modified sequence opt5 from hemagglutinin__InfluenzaA__AGQ80981

SEQ ID NO: 193225 - RNA, 1683 nt, Artificial Sequence; identical to SEQ ID NO: 193204
  derived and/or modified sequence opt5 from hemagglutinin__InfluenzaA__AGQ80982

SEQ ID NO: 193226 - RNA, 1683 nt, Artificial Sequence; identical to SEQ ID NO: 193204
  derived and/or modified sequence opt5 from hemagglutinin__InfluenzaA__AGQ80983

SEQ ID NO: 193227 - RNA, 1683 nt, Artificial Sequence; identical to SEQ ID NO: 193204
  derived and/or modified sequence opt5 from hemagglutinin__InfluenzaA__AGQ80984

SEQ ID NO: 193228 - RNA, 1683 nt, Artificial Sequence; identical to SEQ ID NO: 193204
  derived and/or modified sequence opt5 from hemagglutinin__InfluenzaA__AGQ80985

SEQ ID NO: 193229 - RNA, 1683 nt, Artificial Sequence; identical to SEQ ID NO: 193204
  derived and/or modified sequence opt5 from hemagglutinin__InfluenzaA__AGQ80986

SEQ ID NO: 193230 - RNA, 1683 nt, Artificial Sequence; identical to SEQ ID NO: 193204
  derived and/or modified sequence opt5 from hemagglutinin__InfluenzaA__AGQ80987

SEQ ID NO: 193231 - RNA, 1683 nt, Artificial Sequence; identical to SEQ ID NO: 193204
  derived and/or modified sequence opt5 from hemagglutinin__InfluenzaA__AGQ80988

SEQ ID NO: 193232 - RNA, 1683 nt, Artificial Sequence
  derived and/or modified sequence opt5 from hemagglutinin__InfluenzaA__AGQ80990
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccuaagauuuguucuaaaggcaagcgcgccguggaucuggggcaaugcggacuccugggcacaaucaccgggccgccccagugugaccaguuucuugaguucagcgccgaucugaucauugaaagacgggagggauccgacgucugcuacccuggcaaauuugugaaugaggaagcucuccgccagauccugagagagucuggcgggauugauaaggaaacgaugggauucaccuauagcggcauccggacaaacggggccaccuccgcuugucgcagaucuggaagcuccuuuuacgccgagaugaaguggcugcucagcaauacagacaacgcggccuucccccaaaccacgaaaucuuauaagaauacacggaaagauccugcucugauuaucuggggcauucaccauuccgggagcaccacagagcagaccaagcucuacggaucuggcaacaaacugaucaccguuggcuccagcaauuaucagcagucuuuugugcccuccccuggggcccgcccgcaagucaacggacagagcggcagaaucgacuuccacuggcucaugcugaaucccaacgauacagugacguuuuccuucaauggggcuuuuauugccccugaccgggcgucuuuccuucgcggaaagagcaugggcauccaguccggggugcaggucgaugccaacugcgaaggagacuguuaccauaacggcggcaccauuaucagcaaucugcccuuucaaaacauuaauucuagagcuguugggaagugcccucgguaugugaaacaggagucccuccugcuggccacaggaaugaagaacgugcccgaaaucccgaaaggccgcgggcuuuucggagcuaucgccggcuucauugagaaugggugggaaggccugaucgauggaugguacggcuuuagacaccagaacgcccaaggggagggaaccgcugcggacuacaagagcacacagucugccauugaccagaucaccggcaaacuuaaucggcugauugagaagacgaaccagcaauucgaacucaucgauaaugaguuuacagaagucgagagacagaucgggaacgugauuaauuggacccgcgacagcaugaccgaaguuugguccuauaacgcugagcugcuuguggccauggagaaucagcacacaaucgaucuggccgacucugaaaugaacaaacucuacgagcgggucagacgccagcugcgggaaaaugcugaggaagauggaaccggcuguuucgagauuuuucauaagugcgacgaugacuguauggccagcaucagaaacaacacauaugaucacuccaaguaccgcgaggaagcgaugcaaaaucggauucagaucgacccugugaaacugagcucuggguauaaggauguuauucucugguucuccuuuggcgcuagcugcuucauccugcuugccaucgccaugggacugguguuuauuugcgucaaaaacggcaauaugagauguacgaucugcauuuga

SEQ ID NO: 193233 - RNA, 1683 nt, Artificial Sequence; identical to SEQ ID NO: 193218
  derived and/or modified sequence opt5 from hemagglutinin__InfluenzaA__AGQ80991

SEQ ID NO: 193234 - RNA, 1683 nt, Artificial Sequence
  derived and/or modified sequence opt5 from hemagglutinin__InfluenzaA__AGQ80992
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccaaugugccucgcaucuguuccaagggcaaaagaacagucgaucuggggcaaugcggacuccugggcaccauuacggggccgccccagugugaccaguuucuugaguucucugccgaucugaucaucgaacggcgcgagggaagcgacgugugcuacccuggcaaguuuaugaacgaggaagcccucagacagauucugcgggaguccggcgggaucgauaaagaaaccaugggauucacauauucuggcauucgcaccaauggggcuacaagcgccuguagacgguccggaucuagcuuuuacgcugagaugaaguggcugcucuccaacaccgacaaugccgcguucccccaaaugacgaagucuuauaaaaacacacgcaaggauccugcccugaucauuuggggcauccaccauucuggguccaccacagagcagaccaaacuuuacggaagcggcaauaagcugauuaccguuggcagcuccaacuaucagcagagcuuugugcccucuccuggggcuagaccgcaagucaauggacaguccggccggaucgacuuccacuggcucaugcugaaccccaaugauacagugacguuuagcuucaacggggccuuuaucgcuccugaccgcgccugcuuccuuagaggaaaauccaugggcauucagucuggggugcaggucgaugcgagcugugaaggagacugcuaccauuccggcggcaccaucauuagcaaccugcccuuucaaaauaucaacucucgggccguugggaaguguccucgcuaugugaagcaggagucccucaugcuggcuacaggaaugaaaaaugugcccgaaauuccgaagggcagagggcuguucggagccaucgcuggcuucaucgagaacgggugggaaggccucauugauggaugguacggcuuucggcaccagaaugcccaaggggagggaaccgccgcugacuacaaaagcacacagucugcgaucgaccagauuaccggcaagcugaacagacuuaucgagaaaacgaaucagcaauucgaacugauugauaacgaguuuacagaagucgagaagcagaucgggaaugugaucaacuggacccgcgacagcaugaccgaaguuugguccuauaaugccgagcuccugguggcuauggagaaccagcacacaauugaucuugccgacucugaaaugaauaaacuguacgagcgggucaagagacagcuccgcgaaaacgccgaggaagauggaaccggcugcuucgagaucuuucauaagugugacgaugacugcauggcuagcauucggaauaacacauaugaucacuccaaauacagagaggaagccaugcaaaaccgcauccagauugacccugugaagcugagcucuggguauaaagauguuauccugugguucuccuuuggcgcgagcugcuucauucuccuggcuaucgccaugggacuuguguuuaucugugucaagaauggcaacaugcggugcacgauuuguaucuga

SEQ ID NO: 193235 - RNA, 1683 nt, Artificial Sequence; identical to SEQ ID NO: 193204
  derived and/or modified sequence opt5 from hemagglutinin__InfluenzaA__AGQ80993

SEQ ID NO: 193236 - RNA, 1683 nt, Artificial Sequence; identical to SEQ ID NO: 193211
  derived and/or modified sequence opt5 from hemagglutinin__InfluenzaA__AGQ80994

SEQ ID NO: 193237 - RNA, 1683 nt, Artificial Sequence; identical to SEQ ID NO: 193213
  derived and/or modified sequence opt5 from hemagglutinin__InfluenzaA__AGQ80995

SEQ ID NO: 193238 - RNA, 1683 nt, Artificial Sequence; identical to SEQ ID NO: 193213
  derived and/or modified sequence opt5 from hemagglutinin__InfluenzaA__AGQ80996

SEQ ID NO: 193239 - RNA, 1683 nt, Artificial Sequence
  derived and/or modified sequence opt5 from hemagglutinin__InfluenzaA__AGQ80997
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccaauaucccucgcauuuguuccaagggcaaaagaacaguggaucuggggcaaugcggacuccugggcaccaucacggggccgccccagugugaccaguuucuugaguucucugccgaucugaucauugaacggcgcgagggaagcgacgucugcuacccuggcaaguuugugaacgaggaagcccucagacagauccugcgggaguccggcgggauugauaaagaaaccaugggauucacauauucuggcauccgcaccgacggggcuacaagcgccuguagacgguccggaucuagcuuuuacgcugagaugaaguggcugcucuccaauaccgauaacgccgcguucccccaaaugacgaagucuuauaaaaauacacgcaaggacccugcccugauuaucuggggcauucaccauucuggguccaccacagagcagaccaaacuuuacggaagcggcaacaagcugaucaccguuggcagcuccaauuaucagcagagcuuugugcccucuccuggggcuagaccgcaagucaacggacaguccggccggaucgauuuccacuggcucaugcugaaucccaacgacacagugacguuuagcuucaauggggccuuuauugcuccugaucgcgccuccuuccuuagaggaaaaucuaugggcauccagagcggggugcaggucgacgcgaacugcgaaggagauuguuaccauuccggcggcaccauuaucagcaaccugcccuuucaaaauauuaacucucgggccguugggaagugcccucgcuaugugaagcaggagucccuccugcuggcuacaggaaugaaaaaugugcccgaaaucccgaagggcagagggcuuuucggagccaucgcuggcuucauugagaacgggugggaaggccugaucgacggaugguacggcuuucggcaccagaauagccaaggggagggaaccgccgccgacuacaaaucuacacagagcgcuauugaucagaucaccggcaagcucaacagacugauugagaaaacgaaucagcaauucgaacucaucgacaacgaguuuacagaagucgagaagcagaucgggaaugugauuaacuggacccgcgauuccaugaccgaaguuuggucuuauaaugcggagcugcuuguggccauggagaaccagcacacaaucgaccuggcugauagcgaaaugaauaaacucuacgagcgggucaagagacagcugcgcgaaaacgccgaggaagacggaaccggcuguuucgagauuuuucauaagugcgaugacgauuguauggccuccauccggaauaacacauaugaccacagcaaauacagagaggaagcuaugcaaaaccgcauucagaucgauccugugaagcugucuuccggguauaaagacguuauucucugguucagcuuuggcgccucuugcuucauccugcuugcgaucgcuaugggacugguguuuauuugcgucaagaauggcaacaugcgguguacgaucugcauuuga

SEQ ID NO: 193240 - RNA, 1683 nt, Artificial Sequence
  derived and/or modified sequence opt5 from hemagglutinin__InfluenzaA__AGQ81000
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccaauaucccucgcauuuguuccaagggcaaaagaacaguggaucuggggcaaugcggacuccugggcaccaucacggggccgccccagugugaccaguuucuugaguucucugccgaucugaucauugaacggcgcgagggaagcgacgucugcuacccuggcaaguuugugaacgaggaagcccucagacagauccugcgggaguccggcgggauuggaaaagaaaccaugggcuucacauauucugggauccgcaccaauggagcuacaagcgccuguagacgguccggcucuagcuuuuacgcugagaugaaguggcugcucuccaacaccgauaaugccgcguucccccaaaugacaaagagcuauaaaaacacgcgcaaggacccugcccugauuaucugggggauucaccauucuggauccaccacagagcagaccaaacuuuacggcagcggcaauaagcugaucaccguugggucuuccaacuaucagaaaucuuuugugcccagcccuggagcuagaccgcaggucaauggccaauccgggcggaucgauuuccacuggcucaugcugaaccccaaugacacagugacguuuagcuucaacggagccuuuauugcuccugaucgcgccuccuuccuuagaggcaagucuauggggauccagagcggagugcaggucgacgcgaacugcgaaggcgauuguuaccauaauggcgggaccauuaucuccaaccugcccuuucagaauauuaacagccgggccguuggaaagugcccucgcuaugugaaacaagagucucuccugcuggcuacaggcaugaagaaugugcccgaaaucccgaaagggagaggacucuucggcgccaucgcuggguucauugagaacggcugggaaggacugaucgacggcugguacggguuucggcaccagaaugcccagggagagggcaccgccgcugauuacaaguccacacaaagcgcgauugaccagaucaccgggaaacuuaacagacugauugagaagacgaaucagcaguucgaacucaucgacaacgaguuuacagaagucgagaaacaaaucggaaaugugauuaacuggacccgcgauucuaugaccgaaguuuggagcuauaaugccgagcugcuuguggcuauggagaaccagcacacaaucgaccuggccgauuccgaaaugaauaagcucuacgagcgggucaagagacagcugcgcgaaaacgccgaggaagacggcaccggguguuucgagauuuuucauaaaugcgaugacgauuguauggcuucuauccggaacaauacauaugaccacagcaaguacagagaggaagccaugcagaaccgcauucaaaucgauccugugaaacuguccagcggcuauaaggacguuauucucugguucucuuuuggagcguccugcuucauccugcuugcuaucgccaugggccugguguuuauuugcgucaaaaaugggaacaugcgguguacgaucugcauuuga

SEQ ID NO: 193241 - RNA, 1683 nt, Artificial Sequence
  derived and/or modified sequence opt5 from hemagglutinin__InfluenzaA__AGQ81001
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccaauaucccucgcauuuguuccaagggcaaaagaacaguggaucuggggcaaugcggacuccugggcaccaucacggggccgccccagugugaccaguuucuugaguucucugccgaucugaucauugaacggcgcgagggaagcgacgucugcuacccuggcaaguuugugaacgaggaagcccucagacagauccugcgggaguccggcgggauugauaaagaaaccaugggauucacauauucuggcauccgcaccaauggggcuacaagcgccuguagacgguccggaucuagcuuuuacgcugagaugaaguggcugcucuccaacaccgacaaugccgcguucccccaaaugacaaagagcuauaaaaacacgcgcaaggauccugcccugauuaucuggggcauucaccauucuggguccaccacagagcagaccaaacuuuacggaagcggcaauaagcugaucaccguuggcacaucuaacuaucagcaguccuuugugcccagcccuggggcuagaccgcaagucaauggacagucuggccggaucgacuuccacuggcucaugcugaaccccaaugauacggugaccuuuuccuucaacggggccuuuauugcuccugaccgcgccagcuuccuuagaggaaaauccaugggcauccagucuggggugcaggucgaugcgaacugcgaaggagacuguuaccauaauggcggcacaauuaucagcaaccugcccuuucaaaauauuaacucccgggccguugggaagugcccucgcuaugugaagcaggagagccuccugcuggcuaccggaaugaaaaaugugcccgaaaucccgaagggcagagggcuuuucggagccaucgcuggcuucauugagaacgggugggaaggccugaucgauggaugguacggcuuucggcaccagaaugcccaaggggagggaacagccgcugacuacaaaucuacccaguccgcgauugaccagaucacgggcaagcucaacagacugauugagaaaacaaaucagcaauucgaacucaucgauaacgaguuuaccgaaaucgagaagcagauugggaaugucaucaacuggacccgcgacagcaugacagaaguguggucuuauaaugccgagcugcuuguugcuauggagaaccagcacaccauugaucuggccgacagcgaaaugaauaaacucuacgagcgggugaagagacagcugcgcgaaaacgccgaggaagauggaacaggcuguuucgagaucuuucauaagugcgacgaugacuguauggcuuccauucggaacaauacguaugaucacucuaaauacagagaggaagccaugcaaaaccgcauccagauugacccugucaagcugagcuccggguauaaagaugugauccucugguucagcuuuggcgcgucuugcuucauccugcuugcuauugccaugggacugguuuuuaucugcgugaagaauggcaacaugcgguguaccauuugcaucuga

SEQ ID NO: 193242 - RNA, 1683 nt, Artificial Sequence; identical to SEQ ID NO: 193219
  derived and/or modified sequence opt5 from hemagglutinin__InfluenzaA__AGQ81002

SEQ ID NO: 193243 - RNA, 1683 nt, Artificial Sequence; identical to SEQ ID NO: 193219
  derived and/or modified sequence opt5 from hemagglutinin__InfluenzaA__AGQ81003

SEQ ID NO: 193244 - RNA, 1683 nt, Artificial Sequence; identical to SEQ ID NO: 193219
  derived and/or modified sequence opt5 from hemagglutinin__InfluenzaA__AGQ81004

SEQ ID NO: 193245 - RNA, 1683 nt, Artificial Sequence; identical to SEQ ID NO: 193219
  derived and/or modified sequence opt5 from hemagglutinin__InfluenzaA__AGQ81005

SEQ ID NO: 193246 - RNA, 1683 nt, Artificial Sequence; identical to SEQ ID NO: 193219
  derived and/or modified sequence opt5 from hemagglutinin__InfluenzaA__AGQ81006

SEQ ID NO: 193247 - RNA, 1683 nt, Artificial Sequence; identical to SEQ ID NO: 193219
  derived and/or modified sequence opt5 from hemagglutinin__InfluenzaA__AGQ81007

SEQ ID NO: 193248 - RNA, 1683 nt, Artificial Sequence; identical to SEQ ID NO: 193219
  derived and/or modified sequence opt5 from hemagglutinin__InfluenzaA__AGQ81008

SEQ ID NO: 193249 - RNA, 1683 nt, Artificial Sequence
  derived and/or modified sequence opt5 from hemagglutinin__InfluenzaA__AGQ81009
augaacacccagauccugguguucgcccucgucgcuauuauccccacaaaugccgacaagauuugccugggccaccaugcgguuagcaacgggacgaaagugaauacccuuacagagagaggaguggaagucgugaacgcuaccgagacaguugaacggaccuccaucccucgcauuuguucuaagggcaaaagagccguggaucuggggcaaugcggacuccugggcacaaucaccgggccgccccagugugaccaguuucuugaguucagcgccgaucugaucauugaacggcaggagggauccgacgucugcuacccuggcaaguuugugaaugaggaagcucuccgccaaauccugagagagucuggcgggauuaacaaagaaacgaugggauucaccuauagcggcauccggacaaauggggccaccuccgcuugucgcagaucuggaagcuccuuuuacgccgagaugaaguggcugcucagcaacacagauaaugcggccuucccccagaccacgaagucuuauaaaaacacacggaaggacccugcucugauuaucuggggcauucaccauuccgggagcaccacagagcagaccaaacuuuacggaucuggcaauaagcugaucaccguuggcuccagcaacuaucagcaaucuuuugugcccuccccuggggcccgcccgcaggucaauggacagagcggcagaaucgauuuccacuggcucaugcugaaccccaaugacacagugacguuuuccuucaacggggcuuuuauugccccugaucgggcgucuuuccuucgcggaaaaagcaugggcauccaguccggggugcaagucgacgccaacugcgaaggagauuguuaccauaauggcggcaccauuaucagcaaccugcccuuucagaauauuaacucuagagcuguugggaagugcccucgguaugugaagcaggagucccuccugcuggccacaggaaugaaaaaugugcccgaaaucccgaagggccgcgggcuuuucggagcuaucgccggcuucauugagaacgggugggaaggccuggucgacggaugguacggcuuuagacaccaaaaugcccagggggagggaaccgcugcggauuacaaaagcacacagucugccaucgaccagauuaccggcaagcucaaccggcugaucgagaaaacgaaucaacaguucgaacucauugacaacgaguuuacagaaguggagagacagaucgggaauguuaucaacuggacccgcgauagcaugaccgaagugugguccuauaaugcugagcugcuugucgccauggagaaccagcacacaauugaccuggccgauucugaaaugaauaagcucuacgagcgggugagacgccaacugcgggaaaacgcugaggaagacggaaccggcuguuucgagaucuuucauaaaugcgaugacgauuguauggccagcauuagaaacaauacauaugaccacuccaaguaccgcgaggaagcgaugcagaaccggauccagauugauccuguuaagcugagcucuggguauaaagacgugauccucugguucuccuuuggcgcuagcugcuucauucugcuugccaucgccaugggacuggucuuuaucugcgugaagaauggcaacaugagauguacgauuugcaucuga

SEQ ID NO: 193250 - RNA, 1683 nt, Artificial Sequence
  derived and/or modified sequence opt5 from hemagglutinin__InfluenzaA__AGQ81011
augaacacccagauccugguguucgcccucauugcuaucacacccacgaauagcgacaagauuugccugggccaccaugccgucuccaacgggaccaaaguuaauacacuuaccgagagaggaguggaaguggucaacgcgacagagaccguggaacggacaucuaucccucgcauuuguagcaagggcaaaagaaccguugaucuggggcaaugcggacuccugggcacgaucaccgggccgccccagugugaccaguuucuugaguucuccgcugaucugaucauugaacggcgcgagggaucugacgugugcuacccuggcaaguuugucaaugaggaagcccucagacagauccugcgggagagcggcgggauugauaaagaagccaugggauucacauauuccggcauccgcaccaacggggcuacaucugccuguagacggagcgaguccagcuuuuacgcugagaugaaguggcugcucucuaauaccgacaacgccgcguuucccccuaugacgaaguccuauaaaaauacacgcaaggcccccgcucugauuaucuggggcauucaccauagcggaucuaccgccgaacaaacaaaacuuuacggguccggaaacaagcuggugaccguuagaagcucuaauuaucagcaguccuucgugccuagcccgggcgcuggccccaaagucaacgggcaguccggacggaucgauuuccacuggcucaugcugaauccuaacgacaccgugacauuuucuuucaauggcgccuuuaucgcgcccgaucgcgccagcuuccuuagagggaaguccaugggcauucaaagcggagugcaggucgacgcuaacugcgagggggauuguuaccauucuggaggcacgaucauuuccaaccugccuuuucagaauaucgacagccggguugugggcaagugcccccgcuaugugaaacagaagucucuccugcuggccaccgggaugaaaaacgucccggaaauuccuaagggaagaggccucuucggggcuaucgccggauucaucgagaauggcugggaagggcugauugauggcugguacggauuucggcaccaaaacgcccagggcgaggggacagcugcggacuacaaaagcacccaguccgccaucaaucaaaugacaggaaaacuuaacagacugauugagaagaccaaucagcaguucgaacucaucgacaacgaguuuacggaaguggagaagcagauuggcaauguuaucaacuggacacgcgauucuaucaccgaaguguggagcuauaaugcugagcugcuugucgccauggagaaccaacacaccauugaccuggccgauuccgaaaugaauaagcucuacgagcgggugaaaagacagcugcgcgaaaacgcugaggaagacgggacaggauguuucgagaucuuucauaagugcgaugacgauuguauggccagcauucggaauaacaccuaugaccacucuaaauacagagaggaagcgaugcagaaccgcauccagauugaucccguuaagcuguccagcggcuauaaagacgugauccucugguucucuuuuggggcuuccugccugauucuucuggccaucgccaugggccucgucuucaucugcgugaagaauggaaacaugcgguguacaauuugcaucuga

SEQ ID NO: 193251 - RNA, 1683 nt, Artificial Sequence
  derived and/or modified sequence opt5 from hemagglutinin__InfluenzaA__AGQ81012
augaacacccagauccugguguucgcccucauugcuaucauucccacaaauagcgacaagaucugccugggccaccaugccgucuccaacgggacgaaaguuaauacccuuacagagagaggaguggaaguggucaacgcgaccgagacaguggaacggaccucuauuccucgcaucuguagcaagggcaaaagaacaguugaucuggggcaaugcggacuccugggcaccaucacggggccgccccagugugaccaguuucuugaguucuccgcugaucugauuaucgaacggcgcgagggaucugacgugugcuacccuggcaaguuugucaaugaggaagcccucagacagauucugcgggagagcggcgggaucaacaaagaagccaugggauucaccuauuccggcauucgcacaaauggggcuaccucugccuguagacggagcggauccagcuuuuacgcugagaugaaguggcugcucucuaacacagauaaugccgcguuucccccuaugaccaaguccuauaaaaacacgcgcaaggcccccgcucugaucauuuggggcauccaccauagcgggucuacagccgagcaaaccaaacuuuacggauccggcaauaagcuggugacaguuagaagcucuaacuaucagcaguccuucgugccuagcccgggcgcugggccccaggucaauggacaauccggccggaucgacuuccacuggcucaugcugaacccuaaugauaccgugaccuuuucuuucaacggggccuuuauugcgcccgaccgcgccagcuuccuuagaggaaaauccaugggcauccagagcggggugcaggucgaugcuaacugcgaaggagacuguuaccauucuggcggcacaauuaucuccaaucugccuuuucagaacauugauagccggguuguggggaagugcccccgcuaugugaagcaaaaaucucuccugcuggccacgggaaugaagaaugucccggagaucccuaaaggcagaggacucuucggggcuaucgccggcuucauugaaaacgggugggagggccugaucgacggaugguacggcuuucggcaccagaaugcccagggggaaggaaccgcugcggauuacaagagcacacaauccgccauuaaccagaugaccggcaaacuuaauagacugaucgagaagacaaaccagcaguucgagcucauugacaaugaauuuaccgagguggaaaaacaaaucgggaacguuaucaauuggacgcgcgacucuauuacagagguguggagcuauaacgcugaacugcuugucgccauggagaaucagcacaccaucgaucuggccgacuccgagaugaacaagcucuacgaacgggugaagagacagcugcgcgagaaugcugaagaggauggaaccggcuguuucgaaauuuuucauaaaugcgacgaugacuguauggccagcauccggaacaacacauaugaucacucuaaguacagagaggaggcgaugcagaaucgcauucaaaucgaccccguuaaacuguccagcggguauaaggaugugauucucugguucucuuuuggcgcuuccugcuucauccugcuugccaucgccaugggacuggucuuuauuugcgugaaaaacggcaauaugcgguguaccaucugcauuuga

SEQ ID NO: 193252 - RNA, 1683 nt, Artificial Sequence
  derived and/or modified sequence opt5 from hemagglutinin__InfluenzaA__AGQ81017
augaacacccagauccugguguucgcccucauugcuaucacacccacgaauagcgacaagauuugccugggccaccaugccgucuccaacgggaccaaaguuaauacacuuaccgagagaggaguggaaguggucaacgcgacagagaccguggaacggacaucuaucccucgcauuuguagcaagggcaaaagaaccguugaucuggggcaaugcggacuccugggcacgaucaccgggccgccccagugugaccaguuucuugaguucuccgcugaucugaucauugaacggcgcgagggaucugacgugugcuacccuggcaaguuugucaaugaggaagcccucagacagauccugcgggagagcggcgggauugauaaagaagccaugggauucacauauuccggcauccgcaccaacggggcuacaucugccuguagacggagcggauccagcuuuuacgcugagaugaaguggcugcucucuaauaccgacaacgccgcguuucccccuaugacgaaguccuauaaaaauacacgcaaggcccccgcucugauuaucuggggcauucaccauagcgggucuaccgccgagcaaacaaaacuuuacggauccggcaacaagcuggugaccguuagaagcucuaauuaucagcaguccuucgugccuagcccgggcgcugggccccaggucaacggacaauccggccggaucgauuuccacuggcucaugcugaauccuaacgacaccgugacauuuucuuucaauggggccuuuaucgcgcccgaucgcgccagcuuccuuagaggaaaauccaugggcauucagagcggggugcaggucgacgcuaacugcgaaggagauuguuaccauucuggcggcacgaucauuuccaaccugccuuuucagaauaucgacagccggguuguggggaagugcccccgcuaugugaagcaaaaaucucuccugcuggccaccggaaugaagaacgucccggagauuccuaaaggcagaggacucuucggggcuaucgccggcuucaucgaaaaugggugggagggccugauugauggaugguacggcuuucggcaccagaacgcccagggggaaggaacagcugcggacuacaagagcacccaauccgccaucaaucagaugacaggcaaacuuaacagacugauugagaagaccaaucagcaguucgagcucaucgacaacgaauuuacggagguggaaaaacaaauugggaauguuaucaacuggacacgcgauucuaucaccgagguguggagcuauaaugcugaacugcuugucgccauggagaaccagcacaccauugaccuggccgauuccgagaugaauaagcucuacgaacgggugaagagacagcugcgcgagaacgcugaagaggacggaacaggcuguuucgaaaucuuucauaaaugcgaugacgauuguauggccagcauucggaauaacaccuaugaccacucuaaguacagagaggaggcgaugcagaaccgcauccaaauugaucccguuaaacuguccagcggguauaaggacgugauccucugguucucuuuuggcgcuuccugcuucauucugcuugccaucgccaugggacuggucuuuaucugcgugaaaaauggcaacaugcgguguacaauuugcaucuga

SEQ ID NO: 193253 - RNA, 1683 nt, Artificial Sequence
  derived and/or modified sequence opt5 from hemagglutinin__InfluenzaA__AGQ81018
augaacacccagauccugguguucgcccucauugcuaucauucccacaaauagcgacaagaucugccugggccaccaugccgucuccaacgggacgaaaguuaauacccuuacagagagaggaguggaaguggucaacgcgaccgagacaguggaacggaccucuauuccucgcaucuguagcaagggcaaaagaacaguugaucuggggcaaugcggacuccugggcaccaucacggggccgccccagugugaccaguuucuugaguucuccgcugaucugauuaucgaacggcgcgagggaucugacgugugcuacccuggcaaguuugucaaugaggaagcccucagacagauucugcgggagagcggcgggaucgugaaagaagccaugggauucaccuauuccggcauucgcacaaacggggcuaccucugccuguagacggagcggauccagcuuuuacgcugagaugaaguggcugcucucuaauacagauaacgccgcguuucccccuaugaccaaguccuauaaaaauacgcgcaaggcccccgcuaucauuaucuggggcauccaccauagcgggucuacagccgagcaaaccaaacuguacggauccggcaacaaacuuguuacagugagaagcucuaauuaucagcaguccuucgucccuagcccgggcgcugggccccaggugaacggacaauccggccggauugacuuccacuggcugaugcucaauccuaacgauaccgugaccuuuucuuucaauggggccuuuaucgcgcccgaccgcgccagcuuccugagaggaaaguccaugggcauucagagcgggguccagguugaugcuaacugcgaaggagacuguuaccauucucggggcacaaucauuuccaaccuuccuuuucagaauaucgauagccgcguggugggcaagugccccagauaugucaagcaaaaaucucugcuccuggccacggggaugaagaacgugccggagaucccuaaaggacggggccuguucggggcuauugccggauucaucgaaaauggcugggaggggcucauugacggcugguacggauuuagacaccagaacgcccagggcgaagggaccgcugcggauuacaagagcacacaauccgccaucaaucagaugaccggaaaacugaaccgccuuauugagaagacaaaucagcaguucgagcugaucgacaacgaauuuaccgagguugaaaaacaaaucggcaaugugauuaacuggacgcgggacucuaucacagaggucuggagcuauaaugcugaacuccugguggccauggagaaccagcacaccauugaucuugccgacuccgagaugaauaagcuguacgaaagaguuaagcgccagcuccgggagaacgcugaagaggaugggaccggauguuucgaaaucuuucauaaaugcgacgaugacuguauggccagcauuagaaauaacacauaugaucacucuaaguaccgcgaggaggcgaugcagaaccggauccaaauugaccccgugaaacuguccagcggcuauaaggaugucauccugugguucucuuuuggggcuuccugcuucauccuccuggccauugccaugggccuuguguuuaucugcgucaaaaauggaaacaugagauguaccauuugcaucuga

SEQ ID NO: 193254 - RNA, 1683 nt, Artificial Sequence; identical to SEQ ID NO: 193253
  derived and/or modified sequence opt5 from hemagglutinin__InfluenzaA__AGQ81019

SEQ ID NO: 193255 - RNA, 1683 nt, Artificial Sequence; identical to SEQ ID NO: 193252
  derived and/or modified sequence opt5 from hemagglutinin__InfluenzaA__AGQ81020

SEQ ID NO: 193256 - RNA, 1683 nt, Artificial Sequence; identical to SEQ ID NO: 193253
  derived and/or modified sequence opt5 from hemagglutinin__InfluenzaA__AGQ81021

SEQ ID NO: 193257 - RNA, 1683 nt, Artificial Sequence; identical to SEQ ID NO: 193252
  derived and/or modified sequence opt5 from hemagglutinin__InfluenzaA__AGQ81022

SEQ ID NO: 193258 - RNA, 1683 nt, Artificial Sequence; identical to SEQ ID NO: 193253
  derived and/or modified sequence opt5 from hemagglutinin__InfluenzaA__AGQ81023

SEQ ID NO: 193259 - RNA, 1683 nt, Artificial Sequence
  derived and/or modified sequence opt5 from hemagglutinin__InfluenzaA__AGQ81025
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucgauaaagaagcuaugggauucaccuauagcggcauucgcacaaacggggugaccuccgccuguagacggucuggaagcuccuuuuacgcugagaugaaguggcugcucagcaauacagacaacgccgcguuucccccuaugaccaagucuuauaaaaauacgcgcaaggcccccgcucugaucauuuggggcauccaccauuccgggagcacagccgagcaaaccaaacuuuacggaucuggcaacaagcugguuacagugagauccagcaauuaucagcagucuuucgucccuuccccgggcgcugggccccaggugaacggacaaagcggccggaucgauuuccacuggcucaugcugaauccuaacgacaccgugaccuuuuccuucaauggggccuuuauugcgcccgaucgcgccucuuuccuuagaggaaaaagcaugggcauccaguccgggguccagguugacgcuaacugcgaaggagauuguuaccauagcggcggcacaauuaucucuaaccugccuuuucagaauauugacucccgggugguggggaagugcccccgcuaugucaagcagaaaagccuccugcuggccacgggaaugaagaacgugccggagaucccuaaaggcagaggacucuucggggcuaucgccggcuucauugaaaaugggugggagggccugaucgauggaugguacggcuuucggcaccaaaacgcccagggggaaggaaccgcugcggacuacaagucuacacaaagcgccauuaaucagaugaccggcaaacuuaacagacugaucgagaagacaaaucagcaguucgggcucauugacaacgaguuuaccgaaguugagaaacaaaucggaaaugugaucaacuggacgcgcgauuccauuacagaagucuggucuuauaaugcugagcugcuuguggccauggaaaaccagcacaccaucgaccuggccgauagcgagaugaauaagcucuacgagcggguuaagagacagcugcgcgaaaacgcugaggaagacggcaccggguguuucgagauuuuucauaaaugcgaugacgauuguauggccuccauccggaauaacacauaugaccacagcaaguacagagaagaggcgaugcagaaccgcauucaaaucgaucccgugaaacugucuuccggcuauaaggacgucauucucugguucagcuuuggagcuucuugcuucauccugcuugccaucgccaugggccugguggucauuugcgugaaaaaugggaacaugcgguguaccaucugcauuuga

SEQ ID NO: 193260 - RNA, 1683 nt, Artificial Sequence
  derived and/or modified sequence opt5 from hemagglutinin__InfluenzaA__AGQ81026
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucgauaaagaagcuaugggauucaccuauagcggcauucgcacaaacggggccaccuccgcuuguagacggucuggaagcuccuuuuacgccgagaugaaguggcugcucagcaauacagacaacgcggccuuucccccuaccacgaagucuuauaaaaauacacgcaaggcucccgcccugaucauuuggggcauccaccauuccgggagcaccgcugagcaaacaaaacuuuacggaucuggcaacaagcuggugaccguuagauccagcaauuaucagcagucuuucgugccuuccccgggcgccgggccccaggucaacggacaaagcggccggaucgauuuccacuggcucaugcugaauccuaacgacaccgugacauuuuccuucaauggggcguuuauugcccccgaucgcgcuucuuuccuuagaggaaaaagcaugggcauccaguccggggugcaggucgacgccaacugcgaaggagauuguuaccauagcggcggcacgauuaucucuaaccugccuuuucagaauauugacucccggguuguggggaagugcccccgcuaugugaagcagaaaagccuccugcuggcuaccggaaugaagaacgucccggagaucccuaaaggcagaggacucuucggggccaucgccggcuucauugaaaaugggugggagggccugaucgauggaugguacggcuuucggcaccaaaacgcucagggggaaggaacagcggccgacuacaagucuacccaaagcgcuauuaaucagaugacaggcaaacuuaacagacugaucgagaagaccaaucagcaguucgagcucauugacaacgaauuuacggagguggaaaaacaaaucgggaauguuaucaacuggacacgcgauuccauuaccgagguguggucuuauaaugccgaacugcuugucgccauggagaaccagcacaccaucgaccuggcugauagcgagaugaauaagcucuacgaacgggugaagagacagcugcgcgagaacgccgaagaggacggaacaggcuguuucgaaauuuuucauaaaugcgaugacgauuguauggcguccauccggaauaacaccuaugaccacagcaaguacagagaggaggcuaugcagaaccgcauucaaaucgaucccguuaaacugucuuccggguauaaggacgugauucucugguucagcuuuggcgccucuugcuucauccugcuugccaucgcuaugggacuggucuuuauuugcgugaaaaauggcaacaugcgguguacaaucugcauuuga

SEQ ID NO: 193261 - RNA, 1683 nt, Artificial Sequence
  derived and/or modified sequence opt5 from hemagglutinin__InfluenzaA__AGQ81027
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucgauaaagaagcuaugggauucaccuauagcggcauucgcacaaacggggugaccuccgccuguagacggucuggaagcuccuuuuacgcugagaugaaguggcugcucagcaauacagacaacgccgcguuucccccuaugaccaagucuuauaaaaauacgcgcaaggcccccgcucugaucauuuggggcauccaccauuccgggagcacagccgagcaaaccaaacuuuacggaucuggcaacaagcugguuacagugagauccagcaauuaucagcagucuuucgucccuuccccgggcgcugggccccaggugaacggacaaagcggccggaucgauuuccacuggcucaugcugaauccuaacgacaccgugaccuuuuccuucaauggggccuuuauugcgcccgaucgcgccucuuuccuuagaggaaaaagcaugggcauccaguccgggguccagguugacgcuaacugcgaaggagauuguuaccauagcggcggcacaauuaucucuaaccugccuuuucagaauauugacucccgggugguggggaagugcccccgcuaugucaagcagaaaagccuccugcuggccacgggaaugaagaacgugccggagaucccuaaaggcagaggacucuucggggcuaucgccggcuucauugaaaaugggugggagggccugaucgauggaugguacggcuuucggcaccaaaacgcccagggggaaggaaccgcugcggacuacaagucuacacaaagcgccauuaaucagaugaccggcaaacuuaacagacugaucgagaagacaaaucagcaguucgagcucauugacaacgaauuuaccgagguugaaaaacaaaucgggaaugugaucaacuggacgcgcgauuccauuacagaggucuggucuuauaaugcugaacugcuuguggccauggagaaccagcacaccaucgaccuggccgauagcgagaugaauaagcucuacgaacggguuaagagacagcugcgcgagaacgcugaagaggacggaaccggcuguuucgaaauuuuucauaaaugcgaugacgauuguauggccuccauccggaauaacacauaugaccacagcaaguacagagaggaggcgaugcagaaccgcauucaaaucgaucccgugaaacugucuuccggguauaaggacgucauucucugguucagcuuuggcgcuucuugcuucauccugcuugccaucgccaugggacugguguuuauuugcgucaaaaauggcaacaugcgguguaccaucugcauuuga

SEQ ID NO: 193262 - RNA, 1683 nt, Artificial Sequence
  derived and/or modified sequence opt5 from hemagglutinin__InfluenzaA__AGQ81028
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucgauaaagaagcuaugggauucaccuauagcggcauucgcacaaacggggccaccuccgcuuguagacggucuggaagcuccuuuuacgccgagaugaaguggcugcucagcaauacagacaacgcggccuuucccccuaccacgaagucuuauaaaaauacacgcaaggcucccgcccugaucauuuggggcauccaccauuccgggagcaccgcugagcaaacaaaacuuuacggaucuggcaacaagcuggugaccguuagauccagcaauuaucagcagucuuucgugccuuccccgggcgccgggccccaggucaacggacaaagcggccggaucgauuuccacuggcucaugcugaauccuaacgacaccgugacauuuuccuucaauggggcguuuauugcccccgaucgcgcuucuuuccuuagaggaaaaagcaugggcauccaguccggggugcaggucgacgccaacugcgaaggagauuguuaccauagcggcggcacgauuaucucuaaccugccuuuucagaauauugacucccggguuguggggaagugcccccgcuaugugaagcagaaaagccuccugcuggcuaccggaaugaagaacgucccggagaucccuaaaggcagaggacucuucggggccaucgccggcuucauugaaaaugggugggagggccugaucgauggaugguacggcuuucggcaccaaaacgcucagggggaaggaacagcggccgacuacaagucuacccaaagcgcuauuaaucagaugacaggcaaacuuaacagacugaucgagaagaccaaucagcaguucgagcucauugacaacgaauuuacggagguggaaaaacaaaucgggaauguuaucaacuggacacgcgauuccauuaccgagauguggucuuauaaugccgaacugcuuguggccauggagaaccagcacaccaucgaccuggcugauagcgagaugaauaagcucuacgaacgggucaagagacagcugcgcgagaacgccgaagaggacggaacaggcuguuucgaaauuuuucauaaaugcgaugacgauuguauggcguccauccggaauaacaccuaugaccacagcaaguacagagaggaggcuaugcagaaccgcauucaaaucgaucccgugaaacugucuuccggguauaaggacguuauucucugguucagcuuuggcgccucuugcuucauccugcuugccaucgcuaugggacugguguuuauuugcgucaaaaauggcaacaugcgguguacaaucugcauuuga

SEQ ID NO: 193263 - RNA, 1683 nt, Artificial Sequence
  derived and/or modified sequence opt5 from hemagglutinin__InfluenzaA__AGQ81029
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucgauaaagaagcuaugggauucaccuauagcggcauucgcacaaacggggugaccuccgccuguagacggucuggaagcuccuuuuacgcugagaugaaguggcugcucagcaauacagacaacgccgcguuucccccuaugaccaagucuuauaaaaauacgcgcaaggcccccgcucugaucauuuggggcauccaccauuccgggagcacagccgagcaaaccaaacuuuacggaucuggcaacaagcugguuacagugagauccagcaauuaucagcagucuuucaugccuuccccgggcgcugggccccaggucaacggacaaagcggccggaucgauuuccacuggcucaugcugaauccuaacgacaccgugaccuuuuccuucaauggggccuuuauugcgcccgaucgcgccucuuuccuuagaggaaaaagcaugggcauccaguccggggugcaggucgacgcuaacugcgaaggagauuguuaccauagcggcggcacaauuaucucuaaccugccuuuucagaauauugacucccggguuguggggaagugcccccgcuaugugaagcagaaaagccuccugcuggccacgggaaugaagaacgucccggagaucccuaaaggcagaggacucuucggggcuaucgccggcuucauugaaaaugggugggagggccugaucgauggaugguacggcuuucggcaccaaaacgcccagggggaaggaaccgcugcggacuacaagucuacacaaagcgccauuaaucagaugaccggcaaacuuaacagacugaucgagaagacaaaucagcaguucgagcucauugacaacgaauuuaccgagguggaaaaacaaaucgggaauguuaucaacuggacgcgcgauuccauuacagagguguggucuuauaaugcugaacugcuugucgccauggagaaccagcacaccaucgaccuggccgauagcgagaugaauaagcucuacgaacgggugaagagacagcugcgcgagaacgcugaagaggacggaaccggcuguuucgaaauuuuucauaaaugcgaugacgauuguauggccuccauccggaauaacacauaugaccacagcaaguacagagaggaggcgaugcagaaccgcauucaaaucgaucccguuaaacugucuuccggguauaaggacgugauucucugguucagcuuuggcgcuucuugcuucauccugcuugccaucgccaugggacuggucuuuauuugcgugaaaaauggcaacaugcgguguaccaucugcauuuga

SEQ ID NO: 193264 - RNA, 1683 nt, Artificial Sequence
  derived and/or modified sequence opt5 from hemagglutinin__InfluenzaA__AGQ81031
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucaacaaagaagcuaugggauucaccuauagcggcauucgcacaaauggggccaccuccgcuuguagacggucuggaagcuccuuuuacgccgagaugaaguggcugcucagcaacacagauaaugcggccuuucccccuaugaccaagucuuauaaaaacacgcgcaaggcucccgcccugaucauuuggggcauccaccauuccgggagcacagcugagcaaaccaaacuuuacggaucuggcaauaagauggugacaguuagauccagcaacuaucagcagucuuucgugccuuccccgggcgccgggccccaggucaauggacaaagcggccggaucgacuuccacuggcugaugcucaacccuaaugauaccgugaccuuuuccuucaacggggcguuuauugcccccgaccgcgcuucuuuccugagaggaaaaagcaugggcauccaguccggggugcaggucgaugccaacugcgaaggagacuguuaccauagcggcggcacaauuaucucuaaucuuccuuuucagaacauugauucccggguuguggggaagugcccccgcuaugugaagcagaaaagccugcuccuggcuacgggaaugaagaaugucccggagaucccuaaaggcagagggcuguucggagccaucgccggcuucauugaaaacgggugggagggccucaucgacggaugguacggcuuucggcaccaaaaugcucagggggaaggaaccgcggccgauuacaagucuacacaaagcgcuauuaaccagaugaccggcaaacugaauagacuuaucgagaagacaaaccagcaguucgagcugauugacaaugaauuuaccgagguggaacgccaaaucgggaacguuaucaauuggacgcgggacuccauuacagagguguggucuuauaacgccgaacuccuggucgccauggagaaucagcacaccaucgaucuugcugacagcgagaugaacaaacuguacgaaagagugaagcgccagcuccgggagaaugccgaagaggauggaaccggcuguuucgaaauuuuucauaagugcgacgaugacuguauggcguccaucagaaacaacacauaugaucacagcaaauaccgcgaggaggcuaugcagaaucggauucaaaucgaccccguuaagcugucuuccggguauaaagaugugauucugugguucagcuuuggcgccucuugcuucauccuccuggccaucgcuaugggacuugucuuuauuugcgugaagaacggcaauaugagauguaccaucugcauuuga

SEQ ID NO: 193265 - RNA, 1683 nt, Artificial Sequence; identical to SEQ ID NO: 193260
  derived and/or modified sequence opt5 from hemagglutinin__InfluenzaA__AGQ81032

SEQ ID NO: 193266 - RNA, 1683 nt, Artificial Sequence; identical to SEQ ID NO: 193261
  derived and/or modified sequence opt5 from hemagglutinin__InfluenzaA__AGQ81033

SEQ ID NO: 193267 - RNA, 1683 nt, Artificial Sequence; identical to SEQ ID NO: 193260
  derived and/or modified sequence opt5 from hemagglutinin__InfluenzaA__AGQ81034

SEQ ID NO: 193268 - RNA, 1683 nt, Artificial Sequence; identical to SEQ ID NO: 193261
  derived and/or modified sequence opt5 from hemagglutinin__InfluenzaA__AGQ81035

SEQ ID NO: 193269 - RNA, 1683 nt, Artificial Sequence; identical to SEQ ID NO: 193261
  derived and/or modified sequence opt5 from hemagglutinin__InfluenzaA__AGQ81036

SEQ ID NO: 193270 - RNA, 1683 nt, Artificial Sequence; identical to SEQ ID NO: 193261
  derived and/or modified sequence opt5 from hemagglutinin__InfluenzaA__AGQ81037

SEQ ID NO: 193271 - RNA, 1683 nt, Artificial Sequence; identical to SEQ ID NO: 193253
  derived and/or modified sequence opt5 from hemagglutinin__InfluenzaA__AGQ81038

SEQ ID NO: 193272 - RNA, 1683 nt, Artificial Sequence; identical to SEQ ID NO: 193253
  derived and/or modified sequence opt5 from hemagglutinin__InfluenzaA__AGQ81039

SEQ ID NO: 193273 - RNA, 1683 nt, Artificial Sequence
  derived and/or modified sequence opt5 from hemagglutinin__InfluenzaA__AGQ81040
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaaggauccugcucugaucauuuggggcauccaccauucuggguccacagccgagcagaccaaacuuuacggaagcggcaauaagcuggugacaguugggucuuccaacuaucagcagagcuuugugcccucuccuggggcuagaccgcaagucaauggacaguccggccggaucgacuuccacuggcucaugcugaaccccaaugauaccgugaccuuuagcuucaacggggccuuuauugcgccugaccgcgccuccuuccuuagaggaaaaucuaugggcauccagagcggggugcagauugaugcuaacugcgaaggagacuguuaccauuccggcggcacaaucauuagcaaucugcccuuucaaaacaucgauucucgggccgucgggaagugcccucgcuauguuaagcagaaaucccuccugcuggcuacgggaaugaagaaugugcccgagaucccgaaaggcagaggccucuucggagccauugccggcuucaucgaaaacgggugggagggccugauugacggaugguacggcuuucggcaccagaaugcucaaggggaaggaaccgcggccgacuacaagagcacacagucugcuaucgaucagauuaccggcaaacuuaacagacugaucgagaagacaaaucagcaauucgagcucaucgacaacgaauuuaccgagguggaaaaacagauugggaaugucaucaacuggacgcgcgauagcauuacagaggugugguccuauaaugccgaacugcuuguugccauggagaaccagcacaccaucgaccuggcugauucugagaugaauaagcucuacgaacgggugaagagacagcugcgcgagaacgccgaagaggacggaaccggcuguuucgaaauuuuucauaaaugcgaugacgauuguauggcgagcauccggaauaacacauaugaccacuccaaguacagagaggaggcuaugcaaaaccgcauucagaucgauccugucaaacugagcucuggguauaaggacgugauccucugguucuccuuuggcgccagcugcuucauucugcuugccaucgcuaugggacugguuuuuauuugcgugaaaaauggcaacaugcgguguaccaucugcauuuga

SEQ ID NO: 193274 - RNA, 1683 nt, Artificial Sequence
  derived and/or modified sequence opt5 from hemagglutinin__InfluenzaA__AGQ81041
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaccacaaagagcuauaaaaacacgcgcaaggauccugcucugaucauuuggggcauccaccauucuggguccaccgccgagcagacaaaacuuuacggaagcggcaauaagcuggugaccguugggucuuccaacuaucagcagagcuuugugcccucuccuggggcuagaccgcaagucaauggacaguccggccggaucgacuuccacuggcucaugcugaaccccaaugauaccgugacauuuagcuucaacggggccuuuauugcgccugaccgcgccuccuuccuuagaggaaaaucuaugggcauccagagcggggugcaggucgaugcuaacugcgaaggagacuguuaccauuccggcggcacgauuaucagcaaucugcccuuucaaaacauugauucucgggccguugggaagugcccucgcuaugugaagcagaaaucccuccugcuggcuaccggaaugaagaaugugcccgagaucccgaaaggcagaggccucuucggagccaucgccggcuucauugaaaacgggugggagggccugaucgacggaugguacggcuuucggcaccagaaugcucaaggggaaggaacagcggccgacuacaagagcacccagucugcuauugaucagaucacaggcaaacuuaacagacugauugagaagaccaaucagcaauucgagcucaucgacaacgaauuuacggaggucgaaaaacagaucgggaaugugauuaacuggacacgcgauagcaucaccgagguuugguccuauaaugccgaacugcuuguggccauggagaaccagcacaccauugaccuggcugauucugagaugaauaagcucuacgaacgggucaagagacagcugcgcgagaacgccgaagaggacggaacaggcuguuucgaaaucuuucauaaaugcgaugacgauuguauggcgagcauucggaauaacaccuaugaccacuccaaguacagagaggaggcuaugcaaaaccgcauccagauugauccugugaaacugagcucuggguauaaggacguuauccucugguucuccuuuggcgccagcugcuucauccugcuugccauugcuaugggacugguguuuaucugcgucaaaaauggcaacaugcgguguacaauuugcaucuga

SEQ ID NO: 193275 - RNA, 1683 nt, Artificial Sequence
  derived and/or modified sequence opt5 from hemagglutinin__InfluenzaA__AGQ81042
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagcuaugggauucaccuauucuggcauucgcacaaauggggccaccagcgcuuguagacgguccggaucuagcuuuuacgccgagaugaaguggcugcucuccaacacagacaaugcggccuucccccaaaugaccaagagcuauaaaaacacgcgcaaggauccugcucugaucauuuggggcauccaccauucuggguccacagccgagcagaccaaacuuuacggaagcggcaauaagcuggugacaguugggucuuccaacuaucagcagagcuuugugcccucuccuggggcuagaccgcaagucaauggacaguccggccggaucgacuuccacuggcucaugcugaaccccaaugauaccgugaccuuuagcuucaacggggccuuuauugcgccugaccgcgccuccuuccuuagaggaaaaucuaugggcauccagagcggggugcaggucgaugcuaacugcgaaggagacuguuaccauuccggcggcacaauuaucagcaaucugcccuuucaaaacauugauucucgggccguugggaagugcccucgcuaugugaagcagaaaucccuccugcuggcuacgggaaugaagaaugugcccgagaucccgaaaggcagaggccucuucggagccaucgccggcuucauugaaaacgggugggagggccugaucgacggaugguacggcuuucggcaccagaaugcucaaggggaaggaaccgcggccgacuacaagagcacacagucugcuauugaucagaucaccggcaaacuuaacagacugauugagaagacaaaucagcaauucgagcucaucgacaacgaauuuaccgaggucgaaaaacagaucgggaaugugauuaacuggacgcgcgauagcaucacagagguuugguccuauaaugccgaacugcuuguggccauggagaaccagcacaccauugaccuggcugauucugagaugaauaagcucuacgaacgggucaagagacagcugcgcgagaacgccgaagaggacggaaccggcuguuucgaaaucuuucauaaaugcgaugacgauuguauggcgagcauucggaauaacacauaugaccacuccaaguacagagaggaggcuaugcaaaaccgcauccagauugauccugugaaacugagcucuggguauaaggacguuauccucugguucuccuuuggcgccagcugcuucauccugcuugccauugcuaugggacugguguuuaucugcgucaaaaauggcaacaugcgguguaccauuugcaucuga

SEQ ID NO: 193276 - RNA, 1683 nt, Artificial Sequence
  derived and/or modified sequence opt5 from hemagglutinin__InfluenzaA__AGQ81043
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccaauauuccucgcaucuguuccaagggcaaaagaacaguugaucuggggcaaugcggacuccugggcaccaucacggggccgccccagugugaccaguuucuugaguucucugccgaucugauuaucgaacggcgcgagggaagcgacgugugcuacccuggcaaguuugucaacgaggaagcccucagacagauucugcgggaguccggcgggaucgauaaagaagagaugggauucaccuauucuggcauucgcacaaauggggcuaccagcgccuguagacgguccggaucuagcuuuuacgcugagaugaaguggcugcucuccaacacagacaaugccgcguucccccaaaugaccaagagcuauaaaaacacgcgcaagucuccugcccugaucguguggggcauucaccauuccguuagcacagcugaacagaccaaacuuuacgggucuggaaauaagcuggugacagucggcuccagcaacuaucagcagucuuuugugcccuccccuggcgccagaccgcaagugaaugggcucagcggacggaucgauuuccacuggcugaugcuuaaccccaaugacaccgucaccuuuuccuucaacggcgcuuuuaucgccccugaucgcgcgucuuuccugagagggaaaagcaugggcauucaguccggaguucagguggacgccaacugcgagggggauuguuaccauagcggaggcacaaucauuucuaaucuccccuuucagaacaucgacucccgggcugugggcaagugcccucgcuaugucaagcaaagaagccugcugcucgccacggggaugaaaaaugugcccgaaauuccgaagggacggggccuguucggggcuaucgccggauucaucgagaacggcugggaagggcuuauugauggcugguacggauuuagacaccagaaugcccagggcgaggggaccgcugcggacuacaaaucuacacaaagcgccaucgaccagauuaccggaaagcugaaccgccucaucgagaaaacaaaucagcaguucgaacugauugauaacgaguuuaaugaaguugagaagcaaaucggcaacgugaucaauuggacccgggacuccauuacggaagucuggucuuauaacgcugagcuucugguggccauggagaaucagcacacaaucgaucucgccgacagcgaaauggauaaacuguacgagagaguuaagcgccagcugcgggaaaacgcugaggaagacgggaccggauguuucgagauuuuucauaagugcgaugacgauuguauggccuccaucagaaauaacaccuaugaccacagcaaauaccgcgaggaagcgaugcagaaccggauucaaaucgauccugugaagcucucuuccggcuauaaagacgucauucugugguucagcuuuggggcuucuugcuucauccuucuggccaucgugaugggccucgucuuuauuugcgugaagaauggaaacaugagauguacaaucugcauuuga

SEQ ID NO: 193277 - RNA, 1683 nt, Artificial Sequence; identical to SEQ ID NO: 193012
  derived and/or modified sequence opt5 from hemagglutinin__InfluenzaA__AGQ81044

SEQ ID NO: 193278 - RNA, 1683 nt, Artificial Sequence; identical to SEQ ID NO: 193012
  derived and/or modified sequence opt5 from hemagglutinin__InfluenzaA__AGQ81045

SEQ ID NO: 193279 - RNA, 1683 nt, Artificial Sequence; identical to SEQ ID NO: 193012
  derived and/or modified sequence opt5 from hemagglutinin__InfluenzaA__AGQ81046

SEQ ID NO: 193280 - RNA, 1683 nt, Artificial Sequence; identical to SEQ ID NO: 193261
  derived and/or modified sequence opt5 from hemagglutinin__InfluenzaA__AGQ81047

SEQ ID NO: 193281 - RNA, 1683 nt, Artificial Sequence; identical to SEQ ID NO: 193260
  derived and/or modified sequence opt5 from hemagglutinin__InfluenzaA__AGQ81049

SEQ ID NO: 193282 - RNA, 1683 nt, Artificial Sequence; identical to SEQ ID NO: 193261
  derived and/or modified sequence opt5 from hemagglutinin__InfluenzaA__AGQ81050

SEQ ID NO: 193283 - RNA, 1683 nt, Artificial Sequence
  derived and/or modified sequence opt5 from hemagglutinin__InfluenzaA__AGQ81051
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucaacaaagaagcuaugggauucaccuauagcggcauucgcacaaauggggccaccuccgcuuguagacggucuggaagcuccuuuuacgccgagaugaaguggcugcucagcaacacagauaaugcggccuuucccccuaugaccaagucuuauaaaaacacgcgcaaggcucccgcccugaucauuuggggcauccaccauuccgggagcacagcugagcaaaccaaacuuuacggaucuggcaauaagcuggugacaguuagauccagcaacuaucagcagucuuucgugccuuccccgggcgccgggccccaggucaauggacaaagcggccggaucgacuuccacuggcucaugcugaacccuaaugauaccgugaccuuuuccuucaacggggcguuuauugcccccgaccgcgcuucuuuccuuagaggaaaaagcaugggcauccaguccggggugcaggucgaugccaacugcgaaggagacuguuaccauagcggcggcacaauuaucucuaaucugccuuuucagaacauugauucccggguuguggggaagugcccccgcuaugugaagcagaaaagccuccugcuggcuacgggaaugaagaaugucccggagaucccuaaaggcagaggacucuucggggccaucgccggcuucauugaaaacgggugggagggccugaucgacggaugguacggcuuucggcaccaaaaugcucagggggaaggaaccgcggccgauuacaagucuacacaaagcgcuauuaaccagaugaccggcaaacuuaauagacugaucgagaagacaaaccagcaguucgagcucauugacaaugaauuuaccgagguggaaaaacaaaucgggaacguuaucaauuggacgcgcgacuccauuacagagguguggucuuauaacgccgaacugcuugucgccauggagaaucagcacaccaucgaucuggcugacagcgagaugaacaagcucuacgaacgggugaagagacagcugcgcgagaaugccgaagaggauggaaccggcuguuucgaaauuuuucauaaaugcgacgaugacuguauggcguccauccggaacaacacauaugaucacagcaaguacagagaggaggcuaugcagaaucgcauucaaaucgaccccguuaaacugucuuccggguauaaggaugugauucucugguucagcuuuggcgccucuugcuucauccugcuugccaucgcuaugggacuggucuuuauuugcgugaaaaacggcaauaugcgguguaccaucugcauuuga

SEQ ID NO: 193284 - RNA, 1683 nt, Artificial Sequence; identical to SEQ ID NO: 193261
  derived and/or modified sequence opt5 from hemagglutinin__InfluenzaA__AGQ81052

SEQ ID NO: 193285 - RNA, 1683 nt, Artificial Sequence
  derived and/or modified sequence opt5 from hemagglutinin__InfluenzaA__AGQ81053
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucaacaaagaagcuaugggauucaccuauagcggcauucgcacaaauggggccaccuccgcuuguagacggucuggaagcuccuuuuacgccgagaugaaguggcugcucagcaacacagauaaugcggccuuucccccuaugaccaagucuuauaaaaacacgcgcaaggcucccgcccugaucauuuggggcauccaccauuccgggagcacagcugagcaaaccaaacuuuacggaucuggcaauaagauggugacaguuagauccagcaacuaucagcagucuuucgugccuuccccgggcgccgggccccaggucaauggacaaagcggccggaucgacuuccacuggcugaugcucaacccuaaugauaccgugaccuuuuccuucaacggggcguuuauugcccccgaccgcgcuucuuuccugagaggaaaaagcaugggcauccaguccggggugcaggucgaugccaacugcgaaggagacuguuaccauagcggcggcacaauuaucucuaaucuuccuuuucagaacauugauucccggguuguggggaagugcccccgcuaugugaagcagaaaagccugcuccuggcuacgggaaugaagaaugucccggagaucccuaaaggcagagggcuguucggagccaucgccggcuucauugaaaacgggugggagggccucaucgacggaugguacggcuuucggcaccaaaaugcucagggggaaggaaccgcggccgauuacaagucuacacaaagcgcuauuaaccagaugaccggcaaacugaauagacuuaucgagaagacaaaccagcaguucgagcugauugacaaugaauuuaccgagguggaaaaacaaaucgggaacguuaucaauuggacgcgcgacuccauuacagagguguggucuuauaacgccgaacuccuggucgccauggagaaucagcacaccaucgaucuugcugacagcgagaugaacaagcuguacgaacgggugaagagacagcuccgcgagaaugccgaagaggauggaaccggcuguuucgaaauuuuucauaaaugcgacgaugacuguauggcguccauccggaacaacacauaugaucacagcaaguacagaaaagaggcuaugcagaaucgcauucaaaucgaccccguuaagcugucuuccggguauaaagaugugauucugugguucagcuuuggcgccucuugcuucauccuccuggccaucgcuaugggacuugucuuuauuugcgugaagaacggcaauaugcgguguaccaucugcauuuga

SEQ ID NO: 193286 - RNA, 1683 nt, Artificial Sequence; identical to SEQ ID NO: 193261
  derived and/or modified sequence opt5 from hemagglutinin__InfluenzaA__AGQ81055

SEQ ID NO: 193287 - RNA, 1683 nt, Artificial Sequence; identical to SEQ ID NO: 193261
  derived and/or modified sequence opt5 from hemagglutinin__InfluenzaA__AGQ81056

SEQ ID NO: 193288 - RNA, 1683 nt, Artificial Sequence; identical to SEQ ID NO: 193261
  derived and/or modified sequence opt5 from hemagglutinin__InfluenzaA__AGQ81057

SEQ ID NO: 193289 - RNA, 1683 nt, Artificial Sequence; identical to SEQ ID NO: 193261
  derived and/or modified sequence opt5 from hemagglutinin__InfluenzaA__AGQ81058

SEQ ID NO: 193290 - RNA, 1683 nt, Artificial Sequence; identical to SEQ ID NO: 193012
  derived and/or modified sequence opt5 from hemagglutinin__InfluenzaA__AGQ81059

SEQ ID NO: 193291 - RNA, 1683 nt, Artificial Sequence; identical to SEQ ID NO: 193012
  derived and/or modified sequence opt5 from hemagglutinin__InfluenzaA__AGQ81060

SEQ ID NO: 193292 - RNA, 1683 nt, Artificial Sequence; identical to SEQ ID NO: 193012
  derived and/or modified sequence opt5 from hemagglutinin__InfluenzaA__AGQ81061

SEQ ID NO: 193293 - RNA, 1683 nt, Artificial Sequence
  derived and/or modified sequence opt5 from hemagglutinin__InfluenzaA__AGQ81081
auggagguggucagccugaucaccauucuccugguuaucacaggcuccaacgccgacaagauuugcaucggguaccagucuacgaauagcaccgaaacaguggauacccuuacagagaacaaugugcccgucacccacgcuaaagaacugcuccauacagagcacaacggaaugcugugugccaccaaucuuggcagaccucugauucucgacacgugcaccaucgaagggcugaucuauggaaacccguccugugauauucugcucggcgggcgggaguggucuuacaucguggagcgccccagcgcgguuaauggacugugcuauccuggcaacguggaaaaucuugaggaacugagaucccucuucucuagcgcuuccagcuaccaacggauucagaucuuucccgacacaauuuggaacgucucuuauuccggcaccagcaaggccuguucugauuccuucuaccgcagcaugagauggcugacacagaaaaauaacgccuauccugugcaggacgcucaauacaccaauaaccgggggcgcaauauccuuuuuauguggggaauuaaccaucccccuacggauacagcccagaccaaccuguacacaagaaccgacaccacaacgucuguugcuaccgaggauaucaaucggacauucaagccgcucaucggcccccgcccucuggugaacgggcugcagggaagaauugacuauuacugggccguccuccggcccggccagacccugcgcaucagauccaaugggaaccuuauugcgccuugguauggacacauccugagcggcgagucccauggccggauucucaaaacagaucuuaauucugggaacugcguggugcaaugucagaccgaacgcggaggccugaauacgacacugcccuuucacaacgucagcaaguacgccuucgggaauugcccgaaguauguuggagugaaaucccucaagcuggcugugggccugagaaacgucccugcccggagcucuagagggcucuuuggagcuaucgccggcuucaucgagggcgggugguccggacugguggcgggcugguacggguuucagcacagcaaugaccagggaaccggcauggccgcugaucgcgacucuacccaaaaagccauugacaagaucacaagcaaaguuaacaauauuguggauaagaugaacaagcaguaugaaaucauugaccaugaguucuccgaaaucgagacccggcuuaauaugaucaacaacaaaauugaugaccagauccaagauauuugggcuuacaaugccgagcugcucguccugcuugaaaaccagaagacacuggacgagcacgaugccaaugugaacaaucucuacaacaaaguuaagagagcucuggggucuaaugcgguggaagacggcaaaggauguuuugagcuguaucauaagugcgauaaccaguguauggaaacgauccgcaauggcaccuacaaccggagaaaauauaaggaggagagccgccucgaacggcagaagauugagggggucaaacuggaauccgagggaacauacaagauccuuaccauuuauagcacaguggccucuucccuggucaucgcuaugggcuucgccgccuuucucuucugggcuaugagcaaugggucuugcagaugcaacaucuguauuuga

SEQ ID NO: 193294 - RNA, 1683 nt, Artificial Sequence
  derived and/or modified sequence opt5 from hemagglutinin__InfluenzaA__AGQ81086
auggagguggucagccugaucaccauucuccugguuaucacaggcuccaacgccgacaagauuugcaucggguaccagucuacgaauagcaccgaaacaguggauacccuuacagagaacaaugugcccgucacccacgcuaaagaacugcuccauacagagcacaacggaaugcugugugccaccaaucuuggcagaccucugauucucgacacgugcaccaucgaagggcugaucuauggaaacccguccugugaucugcuccugggcgggcgggaguggucuuacauuguggagcgccccagcgcgguuaauggacuuugcuauccuggcaacguggaaaaucuggaggaacucagaucccuguucucuagcgcuuccagcuaccaacggauccagauuuuucccgacacaaucuggaacgucucuuauuccggcaccagcaaggccuguucugauuccuucuaccgcagcaugagauggcuuacacagaaaaauaacgccuauccugugcaggacgcucaauacaccaauaaccgggggcgcaauauucuguuuauguggggaaucaaccaucccccuacggauacagcccagaccaaccucuacacaagaaccgacaccacaacgucuguugcuaccgaggauauuaaucggacauucaagccgcugaucggcccccgcccucuggugaacgggcuccagggaagaaucgacuauuacugggccguccugcggcccggccagacccuucgcauuagauccaaugggaaccugaucgcgccuugguauggacacauucucagcggcgagucccauggccggauccugaaaacagaucuuaauucugggaacugcguggugcaaugucagaccgaacgcggaggccugaauacgacacuccccuuucacaacgucagcaaguacgccuucgggaauugcccgaaguauguuggagugaaaucccugaagcuggcugugggccucagaaacgucccugcccggagcucuagagggcuguuuggagcuauugccggcuucaucgagggcgggugguccggacuuguggcgggcugguacggguuucagcacagcaaugaccagggaaccggcauggccgcugaucgcgacucuacccaaaaagccaucgacaagauuacaagcaaaguuaacaauaucguggauaagaugaacaagcaguaugaaauuaucgaccaugaguucuccgaaauugagacccggcugaauaugaucaacaacaaaaucgaugaccagauucaagauaucugggcuuacaaugccgagcuccugguccuucuggaaaaccagaagacacucgacgagcacgaugccaaugugaacaaucuguacaacaaaguuaagagagcucuggggucuaaugcgguggaagacggcaaaggauguuuugagcucuaucauaagugcgauaaccaguguauggaaacgauucgcaauggcaccuacaaccggagaaaauauaaggaggagagccgccuggaacggcagaagaucgagggggucaaacuugaauccgagggaacauacaagauucugaccaucuauagcacaguggccucuucccucgucauugcuaugggcuucgccgccuuucuguucugggcuaugagcaaugggucuugcagaugcaacaucuguaucuga

SEQ ID NO: 193295 - RNA, 1683 nt, Artificial Sequence
  derived and/or modified sequence opt5 from hemagglutinin__InfluenzaA__AGQ81087
auggagaccgugagccugaucacaaugcuccuggucgccacgguuauuaacgcugacaagaucugcauuggcuaccaguccaccaauucuacagaaaccguggauacacuuaccgagaacaaugugcccgucacacacgccaaagaacugcuccauaccgagcacaacgggaugcugugugcgacgaaucuuggacauccucugauccucgauaccugcacaauugaaggccugaucuaugggaacccgagcugugaccugcuccugggaggcagagagugguccuacaucguggagcggcccucugcuguuaaugggcuuugcuauccuggaaacguggaaaaucuggaggaacuccgcagccuguucuccucugccagcuccuaccaacggauucagaucuuucccgacaccauuuggaacgucagcuauucuggcacauccaaggccuguagcgauucuuucuacagauccaugcgcuggcuuacccagaaaaauaacgcuuauccuauccaggacgcccaauacacgaauaacagagagaagaauauucuguuuauguggggcaucaaccaucccccuacagauaccgcucagacaaaccucuacacccggaccgacacaacgaccagcguggccacagaggaaauuaaucgcaccuucaaaccgcugaucgggcccagaccucugguuaacggacuccagggccggaucgauuauuacuggucugugcugaagcccgggcagacacuucgcauuagauccaauggaaaccugaucgcgccuugguauggccacauucucagcggggagucccacggacggguccugaagaccgaccuuaaacgcggcucuugcacggugcaaugucagacagaaaagggcgggcugaauaccacccuccccuuucagaacgugagcaaauacgccuucggaaauugcuccaaguaugucggcguuaaaagccugaagcuggcuguggggcucagaaacgugccgucucgguccagccgcggacuguuuggcgccaucgcuggguucauugagggaggcuggucuggccuugucgccgggugguacggauuucagcacagcaaugaucaaggcguggggauggcggccgacagagauuccacacagaaggcuaucgacaaaaugaccucuaagguuaacaauaucguggacaaaaugaacaagcaguaugaaauuaucaaucaugaguucagcgagauugaaacacggcugaacaugaucaauaacaaaauugaugaccaaauccaggauaucugggccuacaacgcugagcuccugguccuucuggaaaaucagaagacgcucgacgagcacgaugccaacgugaauaaccuguacaauaaaguuaagagagcccugggauccaacgcuguggaagacggcaagggguguuuugagcucuaucauaaaugcgaugaccaguguauggagaccauucgcaauggcacauacaaccggagacgcuaucaagaagagagcaagcuggaacggcagaaaaucgagggagucaaacuugaaucugagggcaccuacaagauucugacaaucuauuccaccguggcgagcucucucgucauugccaugggguucgcugccuuucuguucugggccauguccaauggaagcugcagaugcaacaucuguauuuga

SEQ ID NO: 193296 - RNA, 1683 nt, Artificial Sequence
  derived and/or modified sequence opt5 from hemagglutinin__InfluenzaA__AGQ81092
auggagguggucagccugaucaccauucuccugguuaucacaggcuccaacgccgacaagauuugcaucggguaccagucuacgaauagcaccgaaacaguggauacccuuacagagaacaaugugcccgucacccacgcuaaagaacugcuccauacagagcacaacggaaugcugugugccaccaaucuuggcagaccucugauucucgacacgugcaccaucgaagggcugaucuauggaaacccguccugugaucugcuccugggcgggcgggaguggucuuacauuguggagcgccccagcgcgguuaauggacuuugcuauccuggcaacguggaaaaucuggaggaacucagaucccuguucucuagcgcuuccagcuaccaacggauccagauuuuucccgacacaaucuggaacgucucuuauaccggcacauccaaggccuguagcgauucuuucuaccgcuccaugagauggcuuacccagaaaaauaacgccuauccugugcaggacgcucaauacacgaauaaccgggggcgcaauauucuguuuauguggggaaucaaccaucccccuacagauaccacacagaccaaccucuacaccagaacagacacgaccacaagcguugccaccgaggauauuaaucggacauucaagccgcugaucggcccccgcccucuggugaacgggcuccagggaagaaucgacuauuacugggcuguccugcggcccggccagacccuucgcauuagaucuaaugggaaccugaucgccccuugguauggacacauucucuccggcgagagccauggccggauccugaaaacggaucuuaaguccgggaauugcguggugcaaugucagacagaacgcggaggccugaacaccacccuccccuuucacaaugucucuaaguacgcguucgggaacugcccgaaauauguuggagucaagagccugaaacuggccgugggccucagaaaugugccugcucgguccagcagagggcuguuuggagccauugcuggcuucaucgagggcggguggucuggacuuguggccggcugguacggguuucagcacuccaacgaccagggaacaggcauggcggccgaucgcgacagcacccaaaaggcuaucgacaaaauuacaucuaagguuaauaacaucguggauaagaugaauaaacaguaugaaauuaucgaccaugaguucagcgaaauugagacgcggcugaacaugaucaauaacaagaucgaugaccagauucaagauaucugggccuacaacgcugagcuccugguccuucuggaaaaucagaaaacccucgacgagcacgaugccaacgugaauaaccuguacaauaagguuaaaagagcccugggguccaacgcuguggaagacggcaagggauguuuugagcucuaucauaaaugcgauaaucaguguauggaaacaauucgcaacggcaccuacaaucggagaaaguauaaggaggagucucgccuggaacggcagaaaaucgagggggucaaacuugaaagcgagggaacauacaagauucugaccaucuauuccacgguggcgagcucucucgucauugccaugggcuucgcugccuuucuguucugggccauguccaacgggagcugcagaugcaauaucuguaucuga

SEQ ID NO: 193297 - RNA, 1683 nt, Artificial Sequence
  derived and/or modified sequence opt5 from hemagglutinin__InfluenzaA__AGQ81095
auggagguggucagccugaucaccauucuccugguuaucacaguguccaacgccgacaagauuugcaucggcuaccagucuacgaauagcaccgaaacagugaacacccuuacagaggauaauguccccgugacccacgcuaaagaacugcuccauacagagcacaacgggaugcugugugccaccaaucuuggaagaccucugauucucgacacgugcaccaucgaaggccugaucuaugggaacccguccugugaucugcuccugggaggccgggaguggucuuacauuguugagcgccccagcgcggugaaugggcuuugcuauccuggaaacgucgaaaaucuggaggaacucagaucccuguucucuagcgcuuccagcuaccaacggauccagauuuuucccgacacaaucuggaacgugucuuauuccggcaccagcaaggccuguucugauuccuucuaccgcagcaugagauggcuuacacagaaaaauaacgccuauccuguucaggacgcucaauacaccaauaaccggggccgcaauauucuguuuaugugggggaucaaccaucccccuacggauacagcccagaccaaccucuacacaagaaccgacaccacaacgucuguggcuaccgaggauauuaaucggacauucaagccgcugaucggaccccgcccucuggucaacggccuccaggggagaaucgacuauuacugggccgugcugaaacccggacagacccuucggauucgcuccaauggcaaccugaucgcgccuugguaugggcacauucucagcggagagucccauggcagaauccugaagacagaucuuaauucuggcaacugcgugguccaaugucagagcgaacgcgggggacugaauaccacgcuccccuuucacaacguuuccaaguacgccuucggcaauugcccgaaauaugugggggucaagagccugaaacuggcugugggacuccggaacgugccugccagaucuucccggggccuguuuggggcuauugccggauucaucgagggcggcuggagcgggcuuguugcgggaugguacggcuuucagcacucuaaugaccaggggacaggaauggccgcugauagagacagcacccaaaaggccaucgacaaaauuaccuccaaggugaacaauaucgucgauaagaugaacaaacaguaugaaauuaucgaccaugaguucucugaaauugagacacgccugaauaugaucaacaacaagaucgaugaccagauucaagauaucugggcuuacaaugccgagcuccuggugcuucuggaaaaccagaaaacccucgacgagcacgaugccaauguuaacaaucuguacaacaaggugaaacgggcucugggcagcaaugcggucgaagacgggaagggcuguuuugagcucuaucauaaaugcgauaaccaguguauggaaacaauuagaaauggaacguacgaccgccggaaguauaaggaggaguccagacuggaacgccagaaaaucgagggcgugaaacuugaaagcgaggggaccuacaagauucugacaaucuauucuaccgucgccuccagccucgugauugcuaugggauucgccgccuuucuguucugggcuaugucuaacggcuccugccggagaaauaucugcaucuga

SEQ ID NO: 193298 - RNA, 1683 nt, Artificial Sequence
  derived and/or modified sequence opt5 from hemagglutinin__InfluenzaA__AGQ81099
auggagaccgugagccugaucacaauucuccugaucgucacgguuuccaacgccgacaagauuugcaucggcuaccagucuaccaauagcacagaaaccguggauacacuuaccgagaacaaugugcccgucacacacgcuaaagaacugcuccauaccgagcacaacgggaugcugugugccacgaaucuuggacauccucugauucucgauaccugcacaaucgaaggccugaucuaugggaacccguccugugaccugcuccugggaggcagagaguggucuuacauuguggagcggcccagcgcgguuaaugggcuuugcuauccuggaaacguggaaaaucuggaggaacuccgcucccuguucucuagcgcuaacuccuaccaaagaauccagauuuuucccgacaccaucuggaaugucagcuauucuggcacauccaaggccuguagcgauucuuucuaccgguccaugcgcuggcuuacccagaaaaacaaugccuauccuacgcaggacgcucaauacacaaacaauagagagaagaacauucuguuuauguggggcaucaaccaucccccuaccgauacagcccagaccaaucucuacacccggacagacacgaccacaagcguggcuaccgaggaaauuaaccgcacauucaaaccgcugaucgggcccagaccucugguuaauggacuccagggccggaucgauuauuacuggucugugcugaagcccgggcagacccuucgcauuagauccaacggaaaucugaucgccccuugguauggccacauucucagcggggagucccacggacggauccugaagacggaccuuaaacgcggcucuugcacaguccaaugucagaccgaaaagggcgggcugaacaccacacuccccuuucagaaugugagcaaauacgcguucggaaacugcuccaaguaugugggcgucaaaagccugaagcuggccguugggcucagaaaugugccgucucgguccagccgcggacuguuuggcgcuauugccggguucaucgagggaggcuggucuggccuuguggcugggugguacggauuucagcacagcaacgaucaaggcgucgggauggccgcggacagagauuccacccagaaggccaucgacaaagugacaucuaagguuaauaacauuguggacaaaaugaauaagcaguaugaaaucauugaucaugaguucagcgaggucgaaacgcggcugaacaugaucaauaacaaaauugacgaucaaauccaggacaucugggcuuacaacgccgagcuccuggugcuucuggaaaaucagaagacccucgaugagcacgacgcuaacguuaauaaccuguacaauaaagugaagagagcccugggauccaacgccgucgaagauggcaagggguguuuugagcucuaucauaaaugcgacgaucaguguauggagacaauucgcaauggcaccuacaaccggagaaaguaucaagaagagagcaaacuggaacgccagaagaucgagggagugaaacuugaaucugagggcacauacaagauucugaccaucuauuccacggucgcuagcucucucgugauugcgaugggguucgccgcuuuucuguucugggccauguccaauggaagcugccggagaaacaucugcauuuga

SEQ ID NO: 193299 - RNA, 1683 nt, Artificial Sequence
  derived and/or modified sequence opt5 from hemagglutinin__InfluenzaA__AGQ81100
auggagaccgugagccugaucacaaugcuccuggucgccacgguuauuaacgcugacaagaucugcauuggcuaccaguccaccaauucuacagaaaccguggauacacuuaccgagaacaaugugcccgucacacacgccaaagaacugcuccauaccgagcacaacgggaugcugugugcgacgaaucuuggacauccucugauccucgauaccugcacaauugaaggccugaucuaugggaacccgagcugugaccugcuccugggaggcagagagugguccuacaucguggagcggcccucugcuguuaaugggcuuugcuauccuggaaacguggaaaaucuggaggaacuccgcagccuguucuccucugccagcuccuaccaacggauucagaucuuucccgacaccauuuggaacgucagcuauucuggcacauccaaggccuguagcgauucuuucuacagauccaugcgcuggcuuacccagaaaaauaacgcuuauccuauccaggacgcccaauacacgaauaacagagagaagaauauucuguuuauguggggcaucaaccaucccccuacagauaccgcucagacaaaccucuacacccggaccgacacaacgaccagcguggccacagaggaaauuaaucgcaccuucaaaccgcugaucgggcccagaccucugguuaacggacuccagggccggaucgauuauuacuggucugugcugaagcccgggcagacacuucgcauuagauccaauggaaaccugaucgcgccuugguauggccacauucucagcggggagucccacggacggauccugaagaccgaccuuaaacgcggcucuugcacgguccaaugucagacagaaaagggcgggcugaauaccacccuccccuuucagaacgugagcaaauacgccuucggaaauugcuccaaguaugugggcgucaaaagccugaagcuggcuguugggcucagaaacgugccgucucgguccagccgcggacuguuuggcgccauugcuggguucaucgagggaggcuggucuggccuuguggccgggugguacggauuucagcacagcaaugaucaaggcgucgggauggcggccgacagagauuccacacagaaggcuaucgacaaaauuaccucuaaggugaacaauaucguugacaaaaugaacaagcaguaugaaauuaucgaucaugaguucagcgagguggaaacacggcugaauaugauuaacaauaaaaucgacgaucaaauccaggacauuugggccuacaacgcugagcuccugguccuucuggaaaaccagaagacgcucgaugagcacgacgccaaugugaacaaucuguacaacaaaguuaagagagcccugggauccaaugcuguggaagauggcaagggguguuuugagcucuaucauaaaugcgacgaucaguguauggagaccauccgcaacggcacauacaaucggagacgcuaucaagaagagagcaagcuggaacggcagaaaauugagggagucaaacuugaaucugagggcaccuacaagauccugacaauuuauuccaccguggcgagcucucucgucaucgccaugggguucgcugccuuucuguucugggccauguccaacggaagcugcagacgcaauauuugcaucuga

SEQ ID NO: 193300 - RNA, 1683 nt, Artificial Sequence
  derived and/or modified sequence opt5 from hemagglutinin__InfluenzaA__AGQ81123
auggagguggucagccugaucaccauucuccugguuaucacaguguccaacgccgacaagauuugcaucggcuaccagucuacgaauagcaccgaaacagugaacacccuuacagaggauaauguccccgugacccacgcuaaagaacugcuccauacagagcacaacgggaugcugugugccaccaaucuuggaagaccucugauucucgacacgugcaccaucgaaggccugaucuaugggaacccguccugugaucugcuccugggaggccgggaguggucuuacauuguugagcgccccagcgcggugaaugggcuuugcuauccuggaaacgucgaaaaucuggaggaacucagaucccuguucucuagcgcuuccagcuaccaacggauccagauuuuucccgacacaaucuggaacgugucuuauuccggcaccagcaaggccuguucugauuccuucuaccgcagcaugagauggcuuacacagaaaaauaacgccuauccuguucaggacgcucaauacaccaauaacaagggccggaauauucuguuuaugugggggaucaaccaucccccuacggauacagcccagaccaaccucuacacacgcaccgacaccacaacgucuguggcuaccgaggauauuaauagaacauucaaaccgcugaucggaccccggccucuggucaacggccuccaggggcgcaucgacuauuacugggccgugcugaagcccggacagacccuucggauuagauccaauggcaaccugaucgcgccuugguaugggcacauucuccugggagagagccauggccgcauccuuaagacagaucucaauuccggcgacugcgugguccaaugucagucugaaagagggggacugaacaccacgcugcccuuucacaauguuagcaaauacgccuucggcaacugcccgaaguaugugggggugaaaucccugaagcucgcugucggacugcggaaugugccugcccgcagcacaagaggccuuuuuggggcuauugccggauucaucgagggcggcuggucugggcugguugcgggaugguacggcuuucagcacuccaacgaucaggggaccggaauggccgcugaccgggacagcacccaaaaagccaucgauaagauuacaucuaaggugaauaacaucgucgacaaaaugaauaagcaguaugaaauuaucgaucaugaguucagcgaaauugagaccagacucaacaugaucaauaacaaaaucgacgaucagauucaagacaucugggcuuacaacgccgagcugcuugugcugcucgaaaaucagaagacacuggaugagcacgacgccaacguuaauaaccuguacaauaaagugaagcgcgcucucggcuccaacgcggucgaagaugggaaaggcuguuuugagcuguaucauaagugcgacaaucaguguauggaaacgauucggaacggaaccuacgauagacgcaaguauaaagaggagucucggcuugaaagacagaagaucgagggcgugaaacuggaaagcgaggggacauacaagauucucaccaucuauuccacagucgccagcucucuggugauugcuaugggauucgccgccuuucuguucugggcuauguccaauggcagcugccgcugcaacaucuguaucuga

SEQ ID NO: 193301 - RNA, 1683 nt, Artificial Sequence
  derived and/or modified sequence opt5 from hemagglutinin__InfluenzaA__AGQ81124
auggagguggccacccugaucacaauucuccuggucaucacgggcagcaacgcugacaagauuugcaucggguaccaauccaccaauucuacagaaaccguugauacacuuaccgagaacaaugugcccgugacacacgccaaagaacugcuccauaccgagcacaacggaaugcugugugcgacgaaucuuggcagaccucugauucucgauaccugcacaaucgaagggcugaucuauggaaacccgagcugugaccugccccucgagggccgggagugguccuacauugucgaacgcccuucugcugugaaugggguuugcuaucccggaaacguggagaaucuggaagaacuuagaagccuguucuccucugccagcuccuaccaacggauccagauuuuuccugacagcaucuggaacgucucuuauuccggcaccagcaaggccuguucugauuccuucuaccgcaauaugagauggcucacacagaaagacaacaauuaucccgugcaggaugcucaauacaccaacaaucggggcaagaacauucuguuuaugugggggaucaaccauccuccgacggacacagcccagaccaaucuuuacacacgcaccgauaccacaacgagcguugcuaccgaggacauuaacagaacauucaaaccccugaucggaccucggccccucgugaauggccugcaggggcgcaucgauuauuacugggccguccugaagccuggacagacccucagagugcggucuaacggcaaucugauugcgcccugguaugggcacauccuucugggagaaucccauggccgcauucucaagacagaccugaaaagcggcaacugcgugguccaaugucagaccgagagagggggacuuaauacgacacugccguuucacaacguuuccaaguacgccuucggcaauugcccuaaauauaucggggugaagucucucaaacuggcugugggacugcggaacguccccgcccgcagcuccagaggccucuuuggggcuauugccggauucaucgaaggcggcuggagcgggcugguggcgggaugguacggcuuucagcacucuaaugaucaggggaccggaauggccgcugaccgggacuccacccaaaaggccaucgauaagauuacaagcaaaguuaacaauaucguggacaagaugaacaaacaguaugagauuaucgaucaugaguucucugagauugagaccagacuuaauaugaucaacgacaagaucgaugaccagauucaagauaucugggcuuacaacgccgaacugcucguccugcuugagaaucagaaaacacuggacgaacacgaugccaacgugaauaaccucuacaauaagguuaaacgcgcucugggcagcaacgcgguggaggacgggaagggcuguuuugaucuguaucauaagugcgacaaucaguguauggaaacgauucggaacggaaccuacaauagacgcaaauaucagaaggagucccggcucgagagacagaaaaucgaaggcgucaagcuggagucugaagggacauacaaaauucuuaccaucuauagcacaguggccuccagccuggucauugcuaugggauucgccgccuuucucuucugggcuaugucuaacggcuccugccgcugcaauaucuguaucuga

SEQ ID NO: 193302 - RNA, 1683 nt, Artificial Sequence
  derived and/or modified sequence opt5 from hemagglutinin__InfluenzaA__AGQ81125
auggagguggccacccugaucacaauucuccuggucaucacgggcagcaacgcugacaagauuugcaucggguaccaguccaccaauucuacagaaaccguugauacacuuaccgagaacaaugugcccgugacacacgccaaagaacugcuccauaccgagcacaacggaaugcugugugcgacgaaucuuggcagaccucugauucucgauaccugcacaaucgaagggcugaucuauggaaacccgagcugugaccugccccucgagggccgggagugguccuacauugucgaacgcccuucugcugugaaugggguuugcuaucccggaaacguggagaaucuggaggaacuuagaagccuguucuccucugccagcuccuaccaacggauccagauuuuuccugacagcaucuggaacgucucuuauuccggcaccagcaaggccuguucugauuccuucuaccgcagcaugagauggcucacacagaaagacaauaacuaucccgugcaggaugcucaauacaccaauaaccggggcaagaauauucuguuuaugugggggaucaaccauccuccgacggacacagcccagaccaaccuuuacacacgcaccgauaccacaacgucuguugcuaccgaggacauuaauagaacauucaaaccccugaucggaccucggccccucgugaacggccugcaggggcgcaucgauuauuacugggccguccugaagccuggacagacccucagagugcgguccaauggcaaccugauugcgcccugguaugggcacauccuucugggagugagccauggccgcauucucaagacagaccugaaauccggcaauugcgucguucaaugucagaccgaaagagggggacuuaacacgacacugccguuucacaaugugucuaaguacgccuucggcaacugcccuaaauauaucggggucaagagccucaaacuggcugugggacugcggaaugugcccgcccgcuccagcagaggccucuuuggggcuauugccggauucaucgagggcggcuggucugggcugguugcgggaugguacggcuuucagcacuccaacgaucaggggaccggaauggccgcugaccgggacagcacccaaaaggccaucgauaagauuacaucuaaagugaauaacaucgucgacaagaugaauaaacaguaugaaauuaucgaucaugaguucagcgaaauugagaccagacuuaacaugaucaaugacaagaucgaugaccagauucaagauaucugggcuuacaacgccgagcugcucgugcugcuugaaaaccagaaaacacuggacgagcacgaugccaauguuaacaaucucuacaacaaggugaaacgcgcucugggcuccaaugcggucgaagacgggaagggcuguuuugaucuguaucauaagugcgacaaccaguguauggagacgauucggaauggaaccuacaacagacgcaaauaucaggaagagucucggcucgagagacaaaagaucgaaggcgugaaacuggagagcgaagggacauacaagauucuuaccaucuauuccacagucgccagcucucuggugauugcuaugggauucgccgccuuucucuucugggcuauguccaauggcagcugccgcugcaacaucuguaucuga

SEQ ID NO: 193303 - RNA, 1683 nt, Artificial Sequence
  derived and/or modified sequence opt5 from hemagglutinin__InfluenzaA__AGQ81126
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgacacgugcacaaucgaaggccugaucuacgggaauccguccugugaucugcuccuggagggaagagaguggucuuauauuguggaacggcccagcgcugugaacgggaccugcuacccuggcaaugucgagaaccuugaagaacugcgcacccucuucuccucugccagcuccuaucagagaauccagauuuuucccgacacaaucuggaaugugaccuacacaggaaccagccggucuuguuccggcagcuucuaucgcucuaugagauggcugacccagaaguccggcuuuuacccuguucaagaugccaaauauacaaacaaucgggggaagaacauucuuuucguguggggaauccaccauccccacacguacaccgaccagacaacccuguacauucgcaaugauacaaccacgagcgucacaaccgaggaacucaacagaaucuuuaaaccugugaucguuccgcggcugcuggugaauggccagcaggggcgcauugacuauuacuggucuguccucaagcccggacaaacccugagagugcgguccaacggcaaccuuaucgcuccuugguaugggcacgugcugagcggaggcucccauggccgcauucucaagacagaucugaaagggggaaauugcgucguucagugucagaccgagaagggcggguucaacucuacacuucccuuucacaauaucagcaaauacgccuucggaacgugcccuaaguaugugaaagugaacucccugaagcucgcuauuggccugagaaauguccccgcccggagcaaccgcgggcuguuuggagcgaucgccggcuucaucgaaggcggguggccgggacucguggcuggcugguacggguuucagcauucuaaugaccaaggaguuggcauggccgcugauagagacuccacccagaaggccguggauaaaauuacaagcaaggucaacaauaucguggacaaaaugaacaagcaguaugagauuaucgaccacgaguucucugagguugagacccggcugaauaugauuaacaauaaaaucgaugaccaaauccaggauauuugggcguacaacgccgaacuucuggugcuccuggagaaucagaagacacuugacgaacacgaugcuaacgucaacaaucuguacaacaaagugaagagagcccucgggagcaaugcuauggaggacggcaagggauguuuugaacuguaucauaaaugcgaugaccaguguauggagaccauccgcaacggcacguacaaucggagaaaguaucgcgaggaaucccggcuggagcaacagagaauugaaggggucaaacucgagucugaaggaaccuacaagauccugacaauuuauagcaccguggccuccagccuuguucuggccaugggcuucgcugcguuccucuuuugggccaugucuaacggguccugccgcugcaauaucuguauuuga

SEQ ID NO: 193304 - RNA, 1683 nt, Artificial Sequence
  derived and/or modified sequence opt5 from hemagglutinin__InfluenzaA__AGQ81127
auggagguggccacccugaucacaauucuccugcuuaucacgggcagcaacgcugacaagauuugcaucggguaccaguccaccaauucuacagaaaccgucgauacacugaccgagaacaauguucccgugacacacgccaaagaacuccugcauaccgagcacaacggaaugcuuugugcgacgaaucugggcagaccucucauucuggauaccugcacaaucgaagggcugaucuauggaaacccgagcugugaccucccccuggagggccgggagugguccuacauuguggaacgcccuucugcugucaauggggugugcuaucccggaaacguugagaaucuugaagaacugagaagccucuucuccucugccagcuccuaccaacggauccagauuuuuccugacagcaucuggaacgugucuuauuccggcaccagcaaggccuguucugauuccuucuaccgcagcaugagauggcugacacagaaaaauaacaauuaucccguccaggacgcucaauacaccaacaaucggggcaagaacauucuuuuuaugugggggaucaaccauccuccgacggauacagcccagaccaaucuguacacacgcaccgacaccacaacgucuguggcuaccgaggauauuaacagaacauucaaaccccucaucggaccucggccccugguuaauggccugcaggggcgcaucgacuauuacugggccgugcucaagccuggacagacccugagaguccgguccaacggcaaucuuauugcgcccugguaugggcacauccugcucggagaaagccauggccgcauucugaagacagaucuuaaauccggcaacugcguggugcaaugucagaccgagagagggggacugaauacgacacucccguuucacaacgucucuaaguacgccuucggcaauugcccuaaauauaucgggguuaagagccugaaacuggcugugggacuccggaacgugcccgcccgcuccagcagaggccuguuuggggcuauugccggauucaucgaaggcggcuggucugggcuugucgcgggaugguacggcuuucagcacuccaaugaccaggggaccggaauggccgcugaucgggacagcacccaaaaggccaucgacaagauuacaucuaaagugaacaauaucguugauaagaugaacaaacaguaugagauuaucgaccaugaguucagcgagauugagaccagacugaauaugaucaacgauaagaucgacgaucagauucaagacaucugggcuuacaacgccgaacuccuggugcuucuggagaaucagaaaacacucgaugaacacgacgccaacgucaauaaccuguacaauaaggugaaacgcgcucugggcuccaacgcgguugaggaugggaagggcuguuuugaccucuaucauaagugcgauaaucaguguauggaaacgauucggaacggaaccuacaauagacgcaaauaucaggaggagucucggcuggaaagacaaaagaucgagggcgugaaacuugaaagcgaggggacauacaagauucugaccaucuauuccacagucgccagcucucucgugauugcuaugggauucgccgccuuucuguucugggcuauguccaacggcagcugccgcugcaauaucuguaucuga

SEQ ID NO: 193305 - RNA, 1683 nt, Artificial Sequence
  derived and/or modified sequence opt5 from hemagglutinin__InfluenzaA__AGQ81128
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggagugguccuacaucguggaacgcccuucugccgucaauggggugugcuaucccggaaacguugagaaucucgaggaacugagaagccuuuucuccucugccagcuccuaccaacggauucagaucuuuccugacagcauuuggaacgugucuuauuccggcaccagcaaggcuuguucugauuccuucuaccgcagcaugagauggcugacacagaaaaauaacaauuaucccguccaggacgcccaauacaccaacaaucggggcaagaacauccucuuuaugugggggauuaaccauccuccgacggauacagcucagaccaaucuguacacacgcaccgacaccacaacgucuguggccaccgaggauaucaacagaacauucaaaccccuuaucggaccucggccccugguuaauggccuccaggggcgcauugacuauuacugggcggugcugaagccuggacagacccugagaguccgguccaacggcaaucucaucgcccccugguaugggcacauucugcuuggagaaagccauggccgcauccugaagacagaucucaaauccggcaacugcguggugcaaugucagaccgagagagggggacugaauacgacacuuccguuucacaacgucucuaaguacgcuuucggcaauugcccuaaauauauugggguuaagagccugaaacucgccgugggacugcggaacgugcccgcucgcuccagcagaggccuguuuggggccaucgcgggauucaucgaaggcggcuggucugggcucgucgccggaugguacggcuuucagcacuccaaugaccaggggaccggaauggcugccgaucgggacagcacccaaaaggcuauugacaagaucacaucuaaagugaacaauauuguugauaagaugaacaaacaguaugacaucauugaucaugaguucagcgaaaucgagaccagacugaauaugaucaacgacaagauugaugaccagauccaagauauuugggccuacaacgccgagcuucuggugcuccuggaaaaucagaaaacacuugacgagcacgaugcuaacgucaauaaccuguacaauaaggugaaacgcgcgcucggcuccaacgccguugaagacgggaagggcuguuuugaucuguaucauaagugcgacaaucaguguauggagacgauccggaacggaaccuacaauagacgcaaauaucaggaagagucucggcuggagagacaaaagauugaaggcgugaaacucgagagcgaagggacauacaagauccugaccauuuauuccacagucgcuagcucucuuguggucgccaugggauucgccgcuuuucuguucugggccauguccaacggcagcugccgcugcaauaucuguaucuga

SEQ ID NO: 193306 - RNA, 1683 nt, Artificial Sequence
  derived and/or modified sequence opt5 from hemagglutinin__InfluenzaA__AGQ81130
auggagaccgugagccugaucacaauucuccuggucguuacgaucggcaacgccgacaagauuugcaucggguaccaguccaccaauucuacagaaaccguggauacacuuaccgagaacaaugugcccgucacacacgcuaaagaacugcuccauaccgagcacaacggaaugcugugugccacgagccuuggccauccucugauucucgauaccugcacaaucgaagggcugaucuauggaaauccguccugugaccugcuccugggcgggagagaguggucuuacauuguggagcggcccagcgcgguuaacggacuuugcuauccuggcaauguggaaaaccuggaggaacuccgcucccuguucucuagcgcuagauccuaccaacggauccagauuuuucccgacaccaucuggaaugucagcuauucuggcacauccaaggccuguagcgauucuuucuaccgcuccaugagauggcuuacccagaaaaacaaugccuauccuauucaggacgcucaauacacgaacaaucaggagaagaacauccuguuuaugugggggauuaaucaucccccuacagauaccgugcagacaaaccucuacacccggaccgacacaacgaccagcguugccacagaggaaaucaaccgcaccuucaaaccgcugaucggacccagaccucuggugaauggccuccaggggcggauugauuauuacuggucuguccugaagcccggacaaacacuucgcaucagauccaacggcaaucugauugcuccuugguaugggcacauccucagcggagagucccacggccggauucugaagaccgaccuuaaacgcggcucuugcacggugcagugucagacagaaaaagggggacugaacaccacccuccccuuucagaaugugagcaaguacgccuucggcaacugcuccaaguauaucgggaugaaaagccugaagcuggcggucggacucagaaauguuccgucucgguccagccgcggccuguuuggggccaucgcuggauucauugagggcggcuggucugggcuuguggccggaugguacggcuuucaacacagcaacgaucagggggugggaauggcugccgacagagauuccacacagaaggcgaucgacaaaauuaccucuaaggucaauaacaucguggacaaaaugaauaagcaauaugaaauuaucgaucaugaguucagcgagguugaaacacggcugaacaugaucaauaacaaaauugacgaucagauccaggacauuugggccuacaaugcugagcuccuggugcuucuggaaaaccagaagacgcucgaugagcacgacgccaacgucaauaaccuguacaauaaagugaagagagcucugggcuuuaacgccguugaagaugggaagggcuguuucgagcucuaucauaaaugcgacgaucaauguauggagaccauccgcaauggaacauacaaccggagaaaguaucaggaagaguccaaacuggaacgccagaagauugagggcgugaaacuugaaagcgaggggaccuacaagauccugacaauuuauucuaccgucgccuccagccucgugaucgcuaugggauuugcggccuuccuguucugggcuaugucuaauggcuccugccggugcaacaucuguauuuga

SEQ ID NO: 193307 - RNA, 1683 nt, Artificial Sequence
  derived and/or modified sequence opt5 from hemagglutinin__InfluenzaA__AGQ81132
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgacacgugcacaaucgaaggccugaucuacgggaauccguccugugaucugcuccuggagggaagagaguggucuuauauuguggaacggcccagcgcugugaacgggaccugcuacccuggcaaugucgagaaccuugaagaacugcgcacccucuucuccucugccagcuccuaucagagaauccagauuuuucccgacacaaucuggaaugugaccuacacaggaaccagccggucuuguuccggcagcuucuaucgcucuaugagauggcugacccagaaguccggcuuuuacccuguucaagaugccaaauauacaaacaaucgggggaagaacauucuuuucguguggggaauccaccauccccacacguacaccgaccagacaacccuguacauucgcaaugauacaaccacgagcgucacaaccgaggaacucaacagaaucuuuaaaccugugaucguuccgcggcugcuggugaauggccagcaggggcgcauugacuauuacuggucuguccucaagcccggacaaacccugagagugcgguccaacggcaaccuuaucgcuccuugguaugggcacgugcugagcggaggcucccauggccgcauucucaagacagaucugaaagggggaaauugcgucguucagugucagaccgagaagggcggguucaacucuacacuucccuuucacaauaucagcaaauacgccuucggaacgugcccuaaguaugugaaagugaacucccugaagcucgcuauuggccugagaaauguccccgcccggagcaaccgcgggcuguuuggagcgaucgccggcuucaucgaaggcggguggccgggacucguggcuggcugguacggguuucagcauucuaaugaccaaggaguuggcauggccgcugauagagacuccacccagaaggccguggauaaaauuacaagcaaggucaacaauaucguggacaaaaugaaccggcaguaugagauuaucgaccacgaguucucugagguugagaccagacugaauaugauuaacaauaagaucgaugaccaaauccaggauauuugggcguacaacgccgaacuucuggugcuccuggagaaucagaaaacacuugacgaacacgaugcuaacgucaacaaucuguacaacaaggugaaacgcgcccucgggagcaaugcuauggaggacggcaagggauguuuugaacuguaucauaagugcgaugaccaguguauggagaccauccggaacggcacguacaauagacgcaaauaucgggaggaauccagacuggagcaacagcgcauugaaggggucaagcucgagucugaaggaaccuacaaaauccugacaauuuauagcaccguggccuccagccuuguucuggccaugggcuucgcugcguuccucuuuugggccaugucuaacggguccugccggugcaauaucuguauuuga

SEQ ID NO: 193308 - RNA, 1683 nt, Artificial Sequence
  derived and/or modified sequence opt5 from hemagglutinin__InfluenzaA__AGQ81133
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgacacgugcacaaucgaaggccugaucuacgggaauccguccugugaucugcuccuggagggaagagaguggucuuauauuguggaacggcccagcgcugugaacgggaccugcuacccuggcaaugucgagaaccuugaagaacugcgcacccucuucuccucugccagcuccuaucagagaauccagauuuuucccgacacaaucuggaaugugaccuacacaggaaccagccggucuuguuccggcagcuucuaucgcucuaugagauggcugacccagaaguccggcuuuuacccuguucaagaugccaaauauacaaacaaucgggggaagaacauucuuuucguguggggaauccaccauccccacacguacaccgaccagacaacccuguacauucgcaaugauacaaccacgagcgucacaaccgaggaacucaacagaaucuuuaaaccugugaucguuccgcggcugcuggugaauggccagcaggggcgcauugacuauuacuggucuguccucaagcccggacaaacccugagagugcgguccaacggcaaccuuaucgcuccuugguaugggcacauucugagcggaggcucccauggccgcauccucaagacagaucugaaaucugggaauugcgugguccagugucagaccgagaagggaggcuucaacagcacacuucccuuucacaauauuuccaaauacgccuucgggacgugcccuaaguauguuaaagugaacagccugaagcucgcuaucggacugagaaaugugcccgcccggucuaaccgcggccuguuuggggcgaucgccggauucauugaaggcggcuggccggggcucgucgcuggaugguacggcuuucagcauuccaaugaccaaggggugggaauggccgcugauagagacagcacccagaaggccguugauaaaaucacaucuaaggugaacaauauugucgacaaaaugaacaagcaguaugagaucauugaccacgaguucagcgagguggagacccggcugaauaugaucaacaauaaaaucgaugaccaaauucaggauaucugggcguacaacgccgaacuucugguucuccuggagaaucagaagacacuugacgaacacgaugcuaacgugaacaaucuguacaacaaagucaagagagcccucggcuccaaugcuauggaggacgggaagggcuguuuugaacuguaucauaaaugcgaugaccaguguauggagaccauucgcaacggaacguacaaucggagaaaguaucgcgaggaaucucggcuggagcaacagagaaucgaaggcgugaaacucgagagcgaagggaccuacaagauucugacaaucuauuccaccgucgccagcucucuugugcuggccaugggauucgcugcguuccucuuuugggccauguccaacggcagcugccgcugcaauauuuguaucuga

SEQ ID NO: 193309 - RNA, 1683 nt, Artificial Sequence
  derived and/or modified sequence opt5 from hemagglutinin__InfluenzaA__AGQ81134
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgauaccugcacaaucgaaggccugaucuacgggaauccguccugugaccugcuccuggagggaagagaguggucuuauauuguggaacggcccagcgcugccaacgggaccugcuacccuggcaauguggagaaccccgaagaacuucgcacgcuguucuccucugccagcuccuaucagagaauccagauuuuuccugacacaaucuggaaugucaccuacacaggaaccagccggucuuguuccggcagcuucuaucgcucuaugagauggcucacccagaaguccggcuuuuaccccgugcaagaugcuaaauauacaaacaaucgggggaagaacauucuguucguuuggggaauccaccauccucacacguacaccgaccagacaacccuuuacauucgcaaugauacaaccacgagcgugacaaccgaggaacugaacagaaucuuuaaaccggucaucgugccccggcuccugguuaauggccagcaggggcgcauugacuauuacuggucugugcugaagccuggacaaacccucagaguccgguccaacggcaaccugaucgcccccugguaugggcacgugcuuagcggaggcucccauggccgcauucugaagacagaucucaaaucugggaauugcgugguccagugucagaccgagaagggaggcuucaacagcacacugccuuuucacaauaucuccaaauacgcuuucgggacgugccccaaguauguuaaagugaacagccuuaagcuggccauuggacucagaaaugugccggcgcggucuaaccgcggccuguuuggggccaucgcuggauucaucgaaggcggcuggccugggcuggucgccggaugguacggcuuucagcauuccaaugaccaaggggugggaauggcugccgauagagacagcacccagaaggcgguugauaaaauuacaucuaaggugaacaauaucgucgacaaaaugaacaagcaguaugagauuaucgaccacgaguucagcgagguggagacccggcucaauaugauuaacaauaaaaucgaugaccaaauccaggauauuugggccuacaacgcugaacugcuuguucugcucgagaaucagaagacacuggacgaacacgaugccaacgugaacaaucuuuacaacaaagucaagagagcucugggcuccaaugccauggaggacgggaagggcuguuuugaacucuaucauaaaugcgaugaccaguguauggagaccauccgcaacggaacguacaaucggagaaaguaucgcgaggaaucucggcuggagcaacagagaauugaaggcgugaaacuggagagcgaagggaccuacaagauccucacaauuuauuccaccgucgccagcucucuggugcuugcuaugggauucgcggccuuccuguuuugggcuauguccaacggcagcugccgcugcaauaucuguauuuga

SEQ ID NO: 193310 - RNA, 1683 nt, Artificial Sequence
  derived and/or modified sequence opt5 from hemagglutinin__InfluenzaA__AGQ81135
auggagguggccaccaucauuacaauccugcucgucauuacgggcagcaacgcugacaagaucugcauuggguaccaguccaccaauucuacagaaaccguugauacacugaccgagaacaaugugcccgugacacacgccaaagaacuucugcauaccgagcacaacggaaugcucugugcgacgaaucugggcagaccucuuauccuggauaccugcacaaucgaagggcucauuuauggaaacccgagcugugaccugccccuggagggccgggagugguccuacaucgucgaacgcccuucugcugugaaugggguuugcuaucccggaaacguggagaaucucgaagaacugagaagccuuuucuccucugccagcuccuaccaacggauucagaucuuuccugacagcauuuggaacgucucuuauuccggcaccagcaaggccuguucugauuccuucuaccgcagcaugagauggcugacacagaaaaauaacaauuaucccgugcaggacgcucaauacaccaacaaucggggcaagaacauccucuuuaugugggggauuaaccauccuccgacggauaaugcccagacaaaccuguacacccgcacagacaccaccacaucuguugcuacggaggauaucaauagaaccuucaaaccccuuaucggaccucggccccuggugaacggccuccaggggcgcauugacuauuacugggccguccugaagccuggacagacacugagagugcgguccaauggcaaccucaucgcgcccugguaugggcacauucugcuuggagaaagccauggccgcauccugaagaccgaucucaaauccggcaauugcgugguccaaugucagacagagagagggggacugaacaccacgcuuccguuucacaauguuucuaaguacagcuucggcaacugcccuaaauauauuggggugaagucccugaaacucgccgugggacugcggaauguccccgcucgcagcucuagaggccuguuuggggccaucgcuggauucaucgaaggcggcugguccgggcucguggccggaugguacggcuuucagcacagcaacgaccaggggacaggaauggcggccgaucgggacucuacccaaaaggcuauugacaagaucaccagcaaaguuaauaacauuguggauaagaugaauaaacaguaugagaucauugaccaugaguucaacgagaucgagacaagacugaacaugaucaauaacaagauugaugaccagauccaagauauuugggccuacaaugcugaacuucugguccuccuggagaaccagaaaacccuugacgaacacgaugccaaugugaacaaucuguacaacaagguuaaacgcgcccucggcuccaaugcuguggaggacgggaagggcuguuuugaucuguaucauaagugcgacaaccaguguauggaaacaauccggaauggaacguacaacagacgcaaauaucaggaggagucucggcuggaaagacaaaagauugagggcgucaaacucgaaagcgaggggaccuacaagauccugacaauuuauuccaccguggcgagcucucuugucaucgccaugggauucgcugccuuucuguucugggccauguccaauggcagcugccgcugcaacaucuguauuuga

SEQ ID NO: 193311 - RNA, 1683 nt, Artificial Sequence
  derived and/or modified sequence opt5 from hemagglutinin__InfluenzaA__AGQ81136
auggagaccaucagccugaugacaauucuccugaucacgaccgccuccaacgcugacaagauuugcaucggccaccagucuacaaauagcaccgaaacaguggauacccuuacagagaccaacguccccguuacgcaugccaaagaacugcuccaaaccgagcacaaugggaugcugugugcgacaaaccuuggacauccucugauucucgacacgugcacaaucgaaggccugaucuacgggaauccguccugugaucugcuccuggagggaagagaguggucuuauauuguggaacggcccagcgcugugaacgggaccugcuacccuggcaaugucgagaaccuugaagaacugcgcacccucuucuccucugccagcuccuaucagagaauccagauuuuucccgacacaaucuggaaugugaccuacacaggaaccagccggucuuguuccggcagcuucuaucgcucuaugagauggcugacccagaaguccggcuuuuacccuguucaagaugccaaauauacaaacaaucgggggaagaacauucuuuucguguggggaauccaccauccccacacguacaccgaccagacaacccuguacauucgcaaugauacaaccacgagcgucacaaccgaggaacucaacagaaucuuuaaaccugugaucguuccgcggcugcuggugaauggccagcaggggcgcauugacuauuacuggucuguccucaagcccggacaaacccugagagugcgguccaacggcaaccuuaucgcuccuugguaugggcacgugcugagcggaggcucccauggccgcauucucaagacagaucugaaagggggaaauugcgucguucagugucagaccgagaagggcggguucaacucuacacuucccuuucacaauaucagcaaauacgccuucggaacgugcccuaaguaugugaaagugaacucccugaagcucgcuauuggccugagaaauguccccgcccggagcaaccgcgggcuguuuggagcgaucgccggcuucaucgaaggcggguggccgggacucguggcuggcugguacggguuucagcauucuaaugaccaaggaguuggcauggccgcugauagagacuccacccagaaggccguggauaaaauuacaagcaaggucaacaauaucguggacaaaaugaaccggcaguaugagauuaucgaccacgaguucucugagguugagaccagacugaauaugauuaacaauaagaucgaugaccaaauccaggauauuuggacauacaacgcggaacuucuggugcuccuggagaaucagaaaacccuugacgaacacgaugccaacgucaacaaucuguacaacaaggugaaacgcgcucucgggagcaaugccauggaggacggcaagggauguuuugaacuguaucauaagugcgaugaccaguguauggagacgauccggaacggcaccuacaauagacgcaaauaucgggaggaauccagacuggagcaacagcgcauugaaggggucaagcucgagucugaaggaacauacaaaauccugaccauuuauagcacaguggcuuccagccuuguucuggccaugggcuucgccgcuuuccucuuuugggcgaugucuaacggguccugccggugcaauaucuguauuuga

SEQ ID NO: 193312 - RNA, 1683 nt, Artificial Sequence; identical to SEQ ID NO: 193307
  derived and/or modified sequence opt5 from hemagglutinin__InfluenzaA__AGQ81137

SEQ ID NO: 193313 - RNA, 1683 nt, Artificial Sequence
  derived and/or modified sequence opt5 from hemagglutinin__InfluenzaA__AGQ81138
auggaggccgcuaccaucauuacaauccugcucgccauuacgggcagcaacgcggacaagaucugcauuggguaccaauccaccaauucuacagaaaccguggauacacugaccgagaacaauguccccguuacacacgcuaaagaacuucugcauaccgagcacaacggaaugcucugugccacgaaucugggcagaccucuuauccuggauaccugcacaaucgaagggcucauuuauggaaacccgagcugugaccugccccuggagggccgggagugguccuacaucguggaacgcccuucugccgugaauggggucugcuaucccggacauguggagaaccucgaagaacugagaagccuuuucuccucugcuagcuccuaccaacggguucagauuuuuccugacagcaucuggaaugugucuuauuccggcaccagcaaggccuguucugauuccuucuaccgcagcaugagauggcugacacagaaaaacaauaacuaucccguccaggacgcucaauacaccaauaacaagggcaaaaauauucucuuuaugugggggaucaaccacccuccgacggauacagcccagaccaaccuguacacacggaccgacaccacaacgucuguggcgaccgaggauauuaaucgcacauucaagccccuuaucggaccuagaccccugguuaacggccuccaggggcggaucgacuauuacugggccgugcugaagccuggacagacccugcgcgucagauccaauggcaaccucauugcucccugguaugggcauauccugcuuggagaaagccacggccggauucugaaaacagaucucaaguccggcaauugcguggugcaaugucagaccgagcgcgggggacugaacacgacacuuccguuucacaaugucucuaaauacgccuucggcaacugcccuaaguauaucgggguuaaaagccugaagcucgcugugggacugagaaaugugcaugcccgguccagccgcggccuguuuggggcgauugccggauucaucgaaggcggcuggucugggcucgucgcuggaugguacggcuuucagcacuccaacgaccaggggaccggaauggccgcugauagagacagcacccaaaaggccaucgacaaaauuacaucuaaggugaauaacaucguugauaaaaugaauaagcaguaugagauuaucgaccaugaguucagcgagauugagacccggcugaacaugaucaaugauaaaaucgacgaucagauucaagacaucugggccuacaacgcugaacuucuggugcuccuggagaaccagaagacacuugaugaacacgacgcgaaugucaacaaucuguacaacaaagugaagagagcccucggcuccaaugcuguugaggaugggaagggcuguuuugaccuguaucacaaaugcgauaaccaguguauggaaacgauucgcaauggaaccuacaaccggagaaaguaucaggaggagucucgccuggaacggcagaaaaucgagggcgugaagcucgaaagcgaggggacauacaaaauucugaccaucuauuccacagucgccagcucucuugugauugccaugggauucgcugccuuucuguucugggcgauguccaauggcagcugcagaugcaacaucuguaucuga

SEQ ID NO: 193314 - RNA, 1683 nt, Artificial Sequence
  derived and/or modified sequence opt5 from hemagglutinin__InfluenzaA__AGQ81139
auggagguggccaccaucauuacaauccugcucgucauuacgggcgggaacgcugacaagaucugcauuggauaccagagcaccaauuccacagaaaccguugauacacugaccgagaacaaugugcccgugacacacgccaaagaacuucugcauaccgagcacaacggcaugcucugugcgacgaaucuggggagaccucuuauccuggauaccugcacaaucgaaggacucauuuauggcaacccgucuugugaccugccccuggaggggcgggaguggagcuacaucgucgaacgcuccucugcugugaauggaguuugcuauccuggcaacguggagaaucucgaagaacugagaagccuuuucuccucugccagcuccuaccaacggauucagaucuuucccgacagcauuuggaacgucucuuauuccggcaccagcaaggccuguucugauuccuucuaccgcagcaugagauggcugacacagaaaaauaacaauuauccugugcaggacgcucaauacaccaacaaucgggggaagaacauccucuuuauguggggaauuaaccaucccccuacggauaaugcccagacaaaccuguacacccgcacagacaccaccacaucuguugcuacggaggauaucaauagaaccuucaaaccgcuuaucggcccccggccucuggugaacgggcuccagggacgcauugacuauuacugggccguccugaagcccggccagacacugagagugcgguccaaugggaaccucaucgcgccuugguauggacacauucugcuuggcgaaagccauggccgcauccugaagaccgaucucaaauccgggaauugcgugguccaaugucagacagagagaggaggccugaacaccacgcuucccuuucacaauguuucuaaguacagcuucgggaacugcccgaaauauauuggagugaagucccugaaacucgccgugggccugcggaaugucccugcucgcagcucuagagggcuguuuggagccaucgcuggcuucaucgaaggcgggugguccggacucguggccggcugguacggguuucagcacagcaacgaccagggaacaggcauggcggccgaucgggacucuacccaaaaggcuauugacaagaucaccagcaaaguuaauaacauuguggauaagaugaauaaacaguaugagaucauugaccaugaguucuccgagaucgagacaagacugaacaugaucaacaauaagauugaugaccagauccaagauauuugggccuacaacgcugaacuucugguccuccuggagaaucagaaaacccuugacgaacacgaugccaacgugaauaaccuguacaauaagguuaaacgcgcccucgggucuaacgcuguggaggacggcaagggauguuuugaucuguaucauaagugcgacaaucaguguauggaaacaauccggaacggcacguacaauagacgcaaauaucaggaggagagccggcuggaaagacaaaagauugagggggucaaacucgaauccgagggaaccuacaagauccugacaauuuauagcaccguggcgucuucccuugucaucgccaugggcuucgcugccuuucuguucugggccaugagcaacgggucuugccgcugcaauaucuguauuuga

SEQ ID NO: 193315 - RNA, 1683 nt, Artificial Sequence
  derived and/or modified sequence opt5 from hemagglutinin__InfluenzaA__AGQ81141
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacggaccugggcagaccucuuauccuggauaccugcacaaucgaagggcucauuuauggaaauccgagcugugaccugccccuggagggccgggagugguccuacaucguggaacgcccuucugccgucaacggggugugcuaucccggaaauguugagaaccucgaggaacugagaagccuuuucuccucugccagcuccuaccaacggauucagaucuuuccugauagcauuuggaaugugucuuauuccggcaccagcaaggcuuguucugacuccuucuaccgcagcaugagauggcugacacagaaaaacaauaacuaucccguccaggaugcccaauacaccaauaaccggggcaagaauauccucuuuaugugggggauuaaccauccuccgacggacacagcucagaccaaccuguacacacgcaccgauaccacaacgucuguggccaccgaggacaucaauagaacauucaaaccccuuaucggaccucggccccugguuaacggccuccaggggcgcauugauuauuacugggcggugcugaagccuggacagacccugagaguccgguccaauggcaaccucaucgcccccugguaugggcacauucugcuuggagaaagccauggccgcauccugaagacagaccucaaauccggcaauugcguggugcaaugucagaccgagagagggggacugaacacgacacuuccguuucacaaugucucuaaguacgcuuucggcaacugcccuaaauauauugggguuaagagccugaaacucgccgugggacugcggaaugugcccgcucgcuccagacggggccuguuuggggccaucgcgggauucaucgaaggcggcuggaccgggcucgucgccggaugguacggcuuucagcacagcaacgaucaggggaccggaauggcugccgacagagacucuacacaaaaggcuauugauaagaucaccuccaaagugaauaacauuguugacaagaugaauaaacaguaugauaucauugaccaugaguucagcgaaaucgagacacgccugaacaugaucaaugauaagauugacgaucagauccaagacauuugggccuacaacgccgagcuucuggugcuccuggaaaaccagaaaacgcuugaugagcacgacgcuaaugucaacaaucuguacaacaaggugaaaggcgcgcucgggucuaaugccguugaagauggcaagggauguuuugaccuguaucauaagugcgacaaccaguguauggagaccauccggaauggcacauacaacagacgcaaauaucaggaagagagccggcuggagagacaaaagauugaaggggugaaacucgaguccgaaggaaccuacaagauccugacaauuuauucuaccgucgcuagcucccuugugaucgccaugggcuucgccgcuuuucuguucugggccaugagcaaugggucuugccgcugcaacaucuguauuuga

SEQ ID NO: 193316 - RNA, 1683 nt, Artificial Sequence
  derived and/or modified sequence opt5 from hemagglutinin__InfluenzaA__AGQ81143
auggagguggccaccaucauuacaauccugcucgucauuacgggcagcaacgcugacaagaucugcauuggguaccaguccaccaauucuacagaaaccguugauacacugaccgagaacaaugugcccgugacacacgccaaagaacuucugcauaccgagcacaacggaaugcucugugcgacgaaucugggcagaccucuuauccuggauaccugcacaaucgaagggcucauuuauggaaacccgagcugugaccugccccuggagggccgggagugguccuacaucgucgaacgcccuucugcugugaaugggguuugcuaucccggaaacguggagaaucucgaagaacugagaagccuuuucuccucugccagcuccuaccaacggauucagaucuuuccugacagcauuuggaacgucucuuauuccggcaccagcaaggccuguucugauuccuucuaccgcagcaugagauggcugacacagaaaaauaacaauuaucccgugcaggacgcucaauacaccaacaaucggggcaagaacauccucuuuaugugggggauuaaccauccuccgacggauaaugcccagacaaaccuguacacccgcacagacaccaccacaucuguugcuacggaggauaucaauagaaccuucaaaccccuuaucggaccucggccccuggugaacggccuccaggggcgcauugacuauuacugggccguccugaagccuggacagacacugagagugcgguccaauggcaaccucaucgcgcccugguaugggcacauucugcuuggagaaagccauggccgcauccugaagaccgaucucaaauccggcaauugcgugguccaaugucagacagagagagggggacugaacaccacgcuuccguuucacaauguuucuaaguacagcuucggcaacugcccuaaauauauuggggugaagucccugaaacucgccgugggacugcggaauguccccgcucgcagcucuagaggccuguuuggggccaucgcuggauucaucgaaggcggcugguccgggcucguggccggaugguacggcuuucagcacagcaacgaccaggggacaggaauggcggccgaucgggacucuacccaaaaggcuauugacaagaucaccagcaaaguuaauaacauuguggauaagaugaauaaacaguaugagaucauugaccaugaguucuccgagaucgagacaagacugaacaugaucaacaauaagauugaugaccagauccaagauauuugggccuacaacgcugaacuucugguccuccuggagaaucagaaaacccuugacgaacacgaugccaacgugaauaaccuguacaauaagguuaaacgcgcccucggcucuaacgcuguggaggacgggaagggcuguuuugaucuguaucauaagugcgacaaucaguguauggaaacaauccggaacggaacguacaauagacgcaaauaucaggaggagagccggcuggaaagacaaaagauugagggcgucaaacucgaauccgaggggaccuacaagauccugacaauuuauagcaccguggcgucuucccuugucaucgccaugggauucgcugccuuucuguucugggccaugagcaacggcucuugccgcugcaauaucuguauuuga

SEQ ID NO: 193317 - RNA, 1683 nt, Artificial Sequence
  derived and/or modified sequence opt5 from hemagglutinin__InfluenzaA__AGQ81144
auggaggccgcuaccaucauuacaauccugcucguggucacgggcagcaacgccgacaagauuugcaucggguaccaguccaccaauucuacagaaaccguugauacacugaccgagaacaaugugcccgugacacacgcgaaagaacuucugcauaccgagcacaacggaaugcucugugcuacgaaucugggcagaccucuuauucuggauaccugcacaaucgaagggcucaucuauggaaacccgagcugugaccugccccuggagggccgggagugguccuacauugucgaacgcccuucugccgugaaugggguuugcuaucccggaaacguggagaaucucgaagaacugagaagccuuuucuccucugccagcuccuaccaacggauccagauuuuuccugacagcaucuggaacgucucuuauggcggcaccuccaaggcuuguagcgauucuuucuaccgcuccaugagauggcugacacagaaaaauaacaauuaucccgugcaggacgcccaauacaccaacaaucgggggaagaacauucucuuuauguggggaaucaaccauccuccgacggauacagcucagaccaaucuguacacacgcaccgacaccacaacgagcguugccaccgaggauauuaacagaacauucaaaccccuuaucggcccucggccccuggugaaugggcuccagggacgcaucgacuauuacugggcgguccugaagccuggccagacccugagagugcggucuaacgggaaucucauugcccccugguauggacacauccugcuuggcgaaucccauggccgcauucugaagacagaucucaaaagcgggaacugcgugguccaaugucagaccgagagaggaggccugaauacgacacuuccguuucacaacguuuccaaguacgcuuucgggaauugcccuaaauauaucggagugaagucucugaaacucgccgugggccugcggaacaugcccgcucgcagcuccagagggcuguuuggagccauugcgggcuucaucgaaggcggguggagcggacucgucgccggcugguacggguuucagcacucuaaugaccagggaaccggcauggcugccgaucgggacuccacccaaaaggcuaucgacaagauuacaagcaaagugaacaauaucguugauaagaugaacaaacaguaugagauuaucgaccaugaguucucugagauugagaccagacugaauaugaucaacgauaagaucgacgaucagauucaagacaucugggccuacaacgccgaacuucuggugcuccuggagaaucagaaaacacuugaugaacacgacgcuaacgucaauaaccuguacaauaaggugaaacgcgcgcucgggagcaacgccguugaggauggcaagggauguuuugaccuguaucauaagugcgauaaucaguguauggaaacgauucggaacggcaccuacaauagacgcaaauaucaggaggagucccggcuggaaagacaaaagaucgagggggugaaacucgaaucugagggaacauacaagauucugaccaucuauagcacagucgcuuccagccuugugauugccaugggcuucgccgcuuuucuguucugggccaugucuaacggguccugccgcugcaauaucuguaucuga

SEQ ID NO: 193318 - RNA, 1683 nt, Artificial Sequence
  derived and/or modified sequence opt5 from hemagglutinin__InfluenzaA__AGQ81146
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggcaaggagugguccuacaucguggaacggccuucugccgucaaugggaugugcuaucccggaaacguggagaaucucgaggaacugcgcagccuuuucuccucugccagcuccuaccaacggauucagaucuuuccugacagcauuuggaacguuucuuauuccggcaccagcaaggcuuguucugauuccuucuacagaagcaugcgcuggcugacacagaaaaauaacaauuaucccgugcaggacgcccaauacaccaacaauagaggcaaaaacauccucuuuaugugggggauuaaccauccuccgacggauacagcucagaccaaucuguacacacggaccgacaccaagacaucugucgccacggaggaaaucaaccgcaccuucaagccccuuaucggaccuagaccccuggugaauggccuccaggggcggauugauuauuacugggcgguucugaaaccuggacagacacugcgcgugagauccaacggcaaucucaucgcccccugguaugggcacauucugcuuggagagagccauggccggauccugaagaccgaccucaaauccggcaacugcgucgugcaaugucagacagaacgcgggggacugaauaccacgcuuccguuucacaacgugucuaaguacgcuuucggcaauugcccuaaauauauuggggucaagagccugaagcucgccguuggacugagaaacgugcccgcucgguccagccgcggccuguuuggggccaucgcgggauucaucgagggcggcuggucugggcucguggccggaugguacggcuuucagcacuccaaugaucaggggacaggaauggcugccgacagagauagcacccaaaaagcuauugacaagaucaccucuaaagucaacaauauuguggacaagaugaacaaacaguaugaaaucauugaucaugaguucagcgagaucgaaacacggcugaauaugaucaacgacaagauugaugaccagauccaagauauuugggccuacaacgccgagcuucugguucuccuggaaaaucagaaaacccuugacgagcacgauuccaacgugaauaaccuguacaauaaggucaagagagcucucggcucuaacgcgguggaagacgggaaaggcuguuuugaucuguaucauaagugcgacaaucaguguauggagacaauccgcaacggaacguacaaucggagaaaauaucaggaggaaagccgccuggagcggcaaaagauugaaggcguuaaacucgaguccgaagggaccuacaagauccugacaauuuauagcaccguggccucuucccuugucaucgcuaugggauucgccgccuuucuguucugggcuaugagcaacggcucuugcagaugcaauaucuguauuuga

SEQ ID NO: 193319 - RNA, 1683 nt, Artificial Sequence
  derived and/or modified sequence opt5 from hemagglutinin__InfluenzaA__AGQ81147
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggcaaggagugguccuacaucguggaacggccuucugccgucaaugggaugugcuaucccggaaacguggagaaucucgaggaacugcgcagccuuuucuccucugccagcuccuaccaacggauucagaucuuuccugacagcauuuggaacguuucuuauuccggcaccagcaaggcuuguucugauuccuucuacagaagcaugcgcuggcugacacagaaaaauaacaauuaucccgugcaggacgcccaauacaccaacaauagaggcaaaaacauccucuuuaugugggggauuaaccauccuccgacggauacaguccagaccaaucuguacacacggaccgacaccaagacaucuguggcuacggaggaaaucaaccgcaccuucaagccccuuaucggaccuagaccccugguuaauggccuccaggggcggauugauuauuacugggccgugcugaaaccuggacagacacugcgcgucagauccaacggcaaucucaucgcgcccugguaugggcacauucugcuuggagagagccauggccggauccugaagaccgaccucaaauccggcaacugcguggugcaaugucagacagaacgcgggggacugaauaccacgcuuccguuucacaacgucucuaaguacgccuucggcaauugcccuaaauauauugggguuaagagccugaagcucgcugugggacugagaaacgugcccgcccgguccagccgcggccuguuuggggcuaucgccggauucaucgagggcggcuggucugggcucgucgcgggaugguacggcuuucagcacuccaaugaucaggggacaggaauggccgcugacagagauagcacccaaaaagccauugacaagaucaccucuaaagugaacaauauuguugacaagaugaacaaacaguaugaaaucauugaucaugaguucagcgagaucgaaacacggcugaauaugaucaacgacaagauugaugaccagauccaagauauuugggcuuacaacgccgagcuucuggugcuccuggaaaaucagaaaacccuugacgagcacgaugccaacgucaauaaccuguacaauaaggugaagagagcucucggcuccaacgcgguugaagacgggaaaggcuguuuugaucuguaucauaagugcgacaaucaguguauggagacaauccgcaacggaacguacaaucggagaaaauaucaggaggaaucucgccuggagcggcaaaagauugaaggcgugaaacucgagagcgaagggaccuacaagauccugacaauuuauuccaccgucgccagcucucuugugaucgcuaugggauucgccgccuuucuguucugggcuauguccaacggcagcugcagaugcaauaucuguauuuga

SEQ ID NO: 193320 - RNA, 1683 nt, Artificial Sequence
  derived and/or modified sequence opt5 from hemagglutinin__InfluenzaA__AGQ81148
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggcaaggagugguccuacaucguggaacggccuucugccgucaaugggaugugcuaucccggaaacguggagaaucucgaggaacugcgcagccuuuucuccucugccagcuccuaccaacggauucagaucuuuccugacagcauuuggaacguuucuuauuccggcaccagcaaggcuuguucugauuccuucuacagaagcaugcgcuggcugacacagaaaaauaacaauuaucccgugcaggacgcccaauacaccaacaauagaggcaaaaacauccucuuuaugugggggauuaaccauccuccgacggauacagcucagaccaaucuguacacacggaccgacaccaagacaucugucgccacggaggaaaucaaccgcaccuucaagccccuuaucggaccuagaccccuggugaauggccuccaggggcggauugauuauuacugggcgguucugaaaccuggacagacacugcgcgugagauccaacggcaaucucaucgcccccugguaugggcacauucugcuuggagagagccauggccggauccugaagaccgaccucaaauccggcaacugcgucgugcaaugucagacagaacgcgggggacugaauaccacgcuuccguuucacaacgugucuaaguacgcuuucggcaauugcccuaaauauauuggggucaagagccugaagcucgccguuggacugagaaacgugcccgcucgguccagccgcggccuguuuggggccaucgcgggauucaucgagggcggcuggucugggcucguggccggaugguacggcuuucagcacuccaaugaucaggggacaggaauggcugccgacagagauagcacccaaaaagcuauugacaagaucaccucuaaagucaacaauauuguggacaagaugaacaaacaguaugaaaucauugaucaugaguucagcgagaucgaaacacggcugaauaugaucaacgacaagauugaugaccagauccaagauauuugggccuacaacgccgagcuucugguucuccuggaaaaucagaaaacccuugacgagcacgaugcuaacgugaauaaccuguacaauaaggucaagagagcgcucggcuccaacgccguggaagacgggaaaggcuguuuugaucuguaucauaagugcgacaaucaguguauggagacaauccgcaacggaacguacaaucggagaaaauaucaggaggaaucucgccuggagcggcaaaagauugaaggcguuaaacucgagagcgaagggaccuacaagauccugacaauuuauuccaccguggcuagcucucuugucaucgccaugggauucgccgcuuuucuguucugggccauguccaacggcagcugcagaugcaauaucuguauuuga

SEQ ID NO: 193321 - RNA, 1683 nt, Artificial Sequence
  derived and/or modified sequence opt5 from hemagglutinin__InfluenzaA__AGQ81149
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccggacacaacggcaugcucugugcuacgaaucuggggagaccucuuauccuggauaccugcacaaucgagggacucauuuauggcaacccgagcugugaccugccccuggaagggcgggagugguccuacaucguggagcgcccuucugccauuaauggagucugcuaucccggcaacguggaaaaucucgaggaacugagaagccuuuucuccucugccagcuccuaccaacggauccagauuuuuccugacagcaucuggaacguuucuuauuccggcaccagcaaggcuuguucugauuccuucuaccgcagcaugagauggcugacacagaaaaauaacaauuaucccgugcaggacgcccaauacaccaacaaucgggggaagaacauucucuuuauguggggaaucaaccauccuccgacggauacagcucagaccaaucuguacacacgcaccgacaccacaacgucugucgccaccgaggauaucaacagaacauucaaaccccuuauuggcccucggccccuggugaaugggcuccagggacgcaucgacuauuacugggcgguucugaagccuggccagacccugagagugcgguccaacgggaaucucauugcccccugguauggacacauccugcuuggcgagagccauggccgcauucugaagacagaucucaaauccgggaacugcgucgugcaaugucagaccgaaagaggaggccugaauacgacacuuccguuucacaacgugucuaaguacgcuuucgggaauugcccuaaauauaucggagucaagagccugaaacucgccguuggccugcggaacgugcccgcucgcuccagcagagggcuguuuggagccaucgcgggcuucauugagggcggguggucuggacucguggccggcugguacggguuucagcacuccaaugaccagggaaccggcauggcugccgaucgggacagcacccaaaaggcuaucgacaagauuacaucuaaagucaacaauaucguggauaagaugaacaaacaguaugaaauuaucgaccaugaguucagcgaaaucgagaccagacugaauaugauuaacgauaagaucgacgaucagauucaagacaucugggccuacaacgccgagcuucugguucuccuggaaaaucagaaaacacuugaugagcacgacgcuaacgugaauaaccuguacaauaaggucaaacgcgcgcucggguccaacgccguggaagauggcaagggauguuuugaccuguaucauaagugcgauaaucaguguauggagacgauucggaacggcaccuacaauagacgcaaauaucaggaagagucucggcuggagagacaaaagaucgaagggguuaaacucgagagcgaaggaacauacaagauucugaccaucuauuccacaguggcuagcucucuugucaucgccaugggcuucgccgcuuuucuguucugggccauguccaacgggagcugccgcugcaauauuuguaucuga

SEQ ID NO: 193322 - RNA, 1683 nt, Artificial Sequence
  derived and/or modified sequence opt5 from hemagglutinin__InfluenzaA__AGQ81150
auggaggccgcuaccaucauuacaauccugcucgugauuacgggcagcaacgccgacaagaucugcauuggguaccaauccaccaauucuacagaaaccgucgauacacugaccgagaacaauguucccgugacacacgcgaaagaacuucugcauaccgagcacaacggaaugcucugugcuacggaccugggcagaccucuuauccuggauaccugcacaaucgaagggcucauuuauggaaauccgagcugugaccugccccuggagggccgggagugguccuacaucguggaacgcccuucugccgucaacggggugugcuaucccggaaauguugagaaccucgaggaacugagaagccuuuucuccucugccagcuccuaccaacggauucagaucuuuccugauagcauuuggaaugugucuuauuccggcaccagcaaggcuuguucugacuccuucuaccgcagcaugagauggcugacacagaaaaacaauaacuaucccguccaggaugcccaauacaccaaugaccggggcaacaauauccucuuuaugugggggauuaaccauccuccgacggauacagugcagaccaaccuguacacacgcaccgacaccacaacgucuguugcuaccgaggauaucaauagaacauucaagccccuuaucggaccucggccccuggugaacggccuccaggggcgcauugacuauuacugggccguccugaaaccuggacagacccugagagugcgguccaauggcaaccucaucgcgcccugguaugggcacauucugcuuggagaaagccauggccgcauccugaagacagaucucaaguccggcaauugcgugguccaaugucagaccgagagagggggacugaacacgacacuuccguuucacaauguuucuaaauacgccuucggcaacugcccuaaguauauuggggugaaaagccugaagcucgcugugggacugcggaauguccccgcccgcuccagcagaggccuguuuggggcuaucgccggauucaucgaaggcggcuggucugggcucguggcgggaugguacggcuuucagcacuccaacgaccaggggaccggaauggccgcugaccgggauagcacccaaaaagccauugacaagaucacaucuaagguuaauaacauuguggauaaaaugaauaagcaguaugacaucauugaucaugaguucagcgaaaucgagaccagacugaacaugaucaaugacaaaauugaugaccagauccaagauauuugggcuuacaacgccgagcuucugguccuccuggaaaaccagaagacacuugacgagcacgaugccaaugugaacaaucuguacaacaaaguuaagcgcgcucucggcuccaaugcgguggaagacgggaaaggcuguuuugaccuguaucauaagugcgauaaccaguguauggagacgauccggaauggaaccuacaacagacgcaaguaucaggaagagucucggcuggagagacagaaaauugaaggcgucaagcucgagagcgaagggacauacaaaauccugaccauuuauuccacaguggccagcucucuugucaucgcuaugggauucgccgccuuucuguucugggcuauguccaauggcagcugccgcugcaacaucuguauuuga

SEQ ID NO: 193323 - RNA, 1683 nt, Artificial Sequence
  derived and/or modified sequence opt5 from hemagglutinin__InfluenzaA__AGQ81152
auggaggccgcuaccaucauuacaauccugcucgugauuacgggcagcaacgccgacaagaucugcauuggguaccaauccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggacugguccuacaucguggagcgcccuucugccgucaauggggugugcuaucccggaaacguugaaaaucucgaggaacugagaagccuuuucuccucugccagcuccuaccaaaagauucagaucuuuccugauagcauuuggaacgugucuuauuccggcaccagcaaggcuuguucugacuccuucuaccggagcaugcgcuggcugacacagaaaaauaacaauuaucccguccaggaugcccaauacaccaacaauagaggcaaaaacauccucuuuaugugggggauuaaccauccuccgacggacacagugcagaccaaucuguacacacggaccgauaccacaacgucuguugcuaccgaggacaucaaccgcacauucaagccccuuaucggaccuagaccccuggugaauggccuccaggggcggauugauuauuacugggccguccugaagccuggacagacccugcgcgugagauccaacggcaaucucaucgcgcccugguaugggcacauucugcuuggagagagccauggccggauccugaaaacagaccucaaguccggcaacugcgugguccaaugucagaccgaacgcgggggacugaauacgacacuuccguuucacaacguuucuaaauacgccuucggcaauugcccuaaguauauuggggugaaaagccugaagcucgcugugggacugagaaacguccccgcccgguccagccgcggccuguuuggggcuaucgccggauucaucgagggcggcuggucugggcucguggcgggaugguacggcuuucagcacuccaaugaucaggggaccggaauggccgcugacagagacagcacccaaaaggccauugauaaaaucacaucuaagguuaacaauauuguggacaaaaugaacaagcaguaugaaaucauugaucaugaguucagcgaaaucgagacccggcugaauaugaucaacgacaaaauugaugaccagauccaagauauuugggcuuacaacgccgagcuucugguccuccuggaaaaucagaagacacuugacgagcacgaugccaacgugaauaaccuguacaauaaaguuaagagagcucucggcuccaacgcgguggaagacgggaagggcuguuuugaucuguaucauaaaugcgacaaucaguguauggagacgauccgcaacggaaccuacaaucggagaaaguaucaggaagagucucgccuggagcggcagaaaauugaaggcgucaagcucgagagcgaagggacauacaaaauccugaccauuuauuccacaguggccagcucucuugucaucgcuaugggauucgccgccuuucuguucugggcuauguccaacggcagcugcagaugcaauaucuguauuuga

SEQ ID NO: 193324 - RNA, 1683 nt, Artificial Sequence
  derived and/or modified sequence opt5 from hemagglutinin__InfluenzaA__AGQ81153
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggacugguccuacaucguggagcgcccuucugccgucaauggggugugcuaucccggaaacguugaaaaucucgaggaacugagaagccuuuucuccucugccagcuccuaccaaaagauucagaucuuuccugauagcauuuggaacgugucuuauggcggcaucuccaaggcuuguagcaauucuuucuaccgguccaugcgcuggcugacccagaaaaacaauaacuaucccguccaggacgcccaauacacaaauaacagagggaaaaacauucucuuuauguggggaaucaaucauccuccgaccaacacgacacagaccgaucuguacacacggaccgacaccacaacgagcguggcuaccgaggauauccaccgcacauucaagccccuuauuggcccuagaccccugguuaaugggcuccagggacggaucgacuauuacugggccgugcugaagccuggccagacccugcgcgucagaucuaacgggaaucucauugcgcccugguauggacauauccugcuuggcaaaucccacggccggauucugaagacagaucucaaaagcgggaacugcguggugcaaugucagaccgagcgcggaggccugaauacgacacuuccguuucacaacgucuccaaguacgccuucgggaauugcccuaaauauaucggaguuaagucucugaagcucgcugugggccugagaaacgugcccgcccggagcucccgcgggcuguuuggagcuaucgccggcuucauugaaggcggguggagcggacucgucgcgggcugguacggguuucagcauucuaaugaccagggaaccggcauggccgcugauagagacuccacccaaaaagccaucgacaagauuacaagcaaagugaacaauaucguugauaagaugaacaaacaguaugagauuaucgaccacgaguucucugaaaucgaaacccggcugaauaugauuaacgauaagaucgacgaucagauucaagacaucugggcuuacaacgccgagcuucuggugcuccuggagaaucagaaaacacuugaugaacaugacgccaacgucaauaaccuguacaauaaggugaagagagcucucgggagcaacgcgguugaggauggcaaaggauguuuugaccuguaucacaagugcgauaaucaguguauggaaacgauucgcaacggcaccuacaaucggagaaaauaucaggaggaaucccgccuggagcggcaaaagaucgagggggugaaacucgaaucugagggaacauacaagauucugaccaucuauagcacagucgccuccagccuugugaucgcuaugggcuucgccgccuuucuguucugggcuaugucuaacggguccugcagaugcaauauuuguaucuga

SEQ ID NO: 193325 - RNA, 1683 nt, Artificial Sequence
  derived and/or modified sequence opt5 from hemagglutinin__InfluenzaA__AGQ81155
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggacugguccuacaucguggagcgcccuucugccgucaauggggugugcuaucccggaaacguugaaaaucucgaggaacugagaagccuuuucuccucugccagcuccuaccaaaagauucagaucuuuccugauagcauuuggaacgugucuuauaauggcaccuccaaggcuuguagcgacucuuucuaccgguccaugcgcuggcugacacagaaaaacaauaacuaucccguccaggaugcccaauacaccaauaacagaggcaaaaacauccucuuuaugugggggauuaaucauccuccgacggacacaacccagacaaaccuguacacccggaccgauacaacgaccagcguggcuacagaggacaucaaucgcaccuucaagccccuuaucggaccuagaccccugguuaacggccuccaggggcggauugauuauuacugggccgugcugaagccuggacagacacugcgcgucagaucuaauggcaaccucaucgcgcccugguaugggcacauucugcuuggagagucccauggccggauccugaaaaccgaccucaagagcggcaauugcguggugcaaugucagacggaacgcgggggacugaacacaacccuuccguuucacaaugucuccaaauacgccuucggcgauugcccuaaguauauugggguuaaaucucugaagcucgcugugggacugagaaacgugcccgcccggagcucccgcggccuguuuggggcuaucgccggauucaucgagggcggcuggagcgggcucgucgcgggaugguacggcuuucagcacucuaaugaccaggggaccggaauggccgcugacagagauuccacacaaaaggccauugacaaaaucaccagcaaggugaacaauauuguugauaaaaugaacaagcaguaugaaaucauugaccaugaguucucugaaaucgagacacggcugaauaugaucaacgauaaaauugacgaucagauccaagacauuugggcuuacaacgccgagcuucuggugcuccuggaaaaucagaagacgcuugaugagcacgacgccaacgucaauaaccuguacaauaaagugaagagagcucucggcagcaacgcgguugaagaugggaagggcuguuuugaccuguaucauaaaugcgacaaucaguguauggagaccauccgcaacggaacauacaaucggagaaaguaucaggaagagucccgccuggagcggcaagaaauugagggcgugaaacucgaaucugaggggaccuacaagauccugacaauuuauagcaccgucgccuccagccuugugaucgcuaugggauucgccgccuuucuguucugggcuaugucuaacggcuccugcagaugcaauaucuguauuuga

SEQ ID NO: 193326 - RNA, 1683 nt, Artificial Sequence
  derived and/or modified sequence opt5 from hemagglutinin__InfluenzaA__AGQ81156
auggaggccgcuaccaucauuacaauccugcucgugauuacgggcagcaacgccgacaagaucugcauuggguaccaauccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggacugguccuacaucguggagcgcccuucugccgucaauggggugugcuaucccggaaacguugaaaaucucgaggaacugagaagccuuuucuccucugccagcuccuaccaaaagauucagaucuuuccugauagcauuuggaacgugucuuauggcggcaucuccaaggcuuguagcaauucuuucuaccgguccaugcgcuggcugacccagaaaaacaauaacuaucccguccaggacgcccaauacacaaauaacagagggaaaaacauucucuuuauguggggaaucaaucauccuccgaccaacacgacacagaccgaucuguacacacggaccgacaccacaacgagcguggcuaccgaggauauccaccgcacauucaagccccuuauuggcccuagaccccugguuaaugggcuccagggacggaucgacuauuacugggccgugcugaagccuggccagacccugcgcgucagaucuaacgggaaucucauugcgcccugguauggacauauccugcuuggcgagucccacggccggauucugaaaacagaucucaagagcgggaacugcguggugcaaugucagaccgaacgcggaggccugaauacgacacuuccguuucacaacgucuccaaauacgccuucgggaauugcccuaaguauaucggaguuaaaucucugaagcucgcugugggccugagaaacgugcccgcccggagcucccgcgggcuguuuggagcuaucgccggcuucauugagggcggguggagcggacucgucgcgggcugguacggguuucagcauucuaaugaccagggaaccggcauggccgcugauagagacuccacccaaaaggccaucgacaaaauuacaagcaaggugaacaauaucguugauaaaaugaacaagcaguaugaaauuaucgaccacgaguucucugaaaucgagacccggcugaauaugauuaacgauaaaaucgacgaucagauucaagacaucugggcuuacaacgccgagcuucuggugcuccuggaaaaucagaagacacuugaugagcaugacgccaacgucaauaaccuguacaauaaagugaagagagcucucgggagcaacgcgguugaagauggcaagggauguuuugaccuguaucacaaaugcgauaaucaguguauggagacgauucgcaacggcaccuacaaucggagaaaguaucaggaagagucccgccuggagcggcagaaaaucgaaggggugaagcucgagucugaaggaacauacaaaauucugaccaucuauagcacagucgccuccagccuugugaucgcuaugggcuucgccgccuuucuguucugggcuaugucuaacggguccugcagaugcaauauuuguaucuga

SEQ ID NO: 193327 - RNA, 1683 nt, Artificial Sequence
  derived and/or modified sequence opt5 from hemagglutinin__InfluenzaA__AGQ81157
auggaggccgcuaccaucauuacaauccugcucgugauuacgggcaacaaugccgacaagaucugcauuggguaccaaagcaccaacuccacagaaaccgucgauacacugaccgagaauaacguucccgugacacacgcgaaagaacuucugcauaccgagcacaauggaaugcucugugcuacgaaccugggcagaccucuuauccuggauaccugcacaaucgaagggcucauuuauggaaauccgucuugugaccugccccuggagggccgggacuggagcuacaucguggagcgcccuuccgccgucaacggggugugcuaucccggaaauguugaaaaccucgaggaacugagaucucuuuucagcuccgccucuagcuaccaaaagauucagaucuuuccugauuccauuuggaaugugagcuauaacggcaccucuaaggcuuguuccgacagcuucuaccggucuaugcgcuggcugacacagaaaaauaacaauuaucccguccaggaugcccaauacaccaacaacagaggcaaaaauauccucuuuaugugggggauuaaccauccuccgacggacacaacccagacaaaucuguacacccggaccgauacaacgaccuccguggcuacagaggacaucaaccgcaccuucaagccccuuaucggaccuagaccccugguuaauggccuccaggggcggauugauuauuacugggccgugcugaagccuggacagacacugcgcgucagaagcaacggcaaucucaucgcgcccugguaugggcacauucugcuuggagagucucauggccggauccugaaaaccgaccucaaguccggcaacugcguggugcaaugucagacggaacgcgggggacugaauacaacccuuccguuucacaacgucagcaaauacgccuucggcgauugcccuaaguauauugggguuaaaucccugaagcucgcugugggacugagaaaugugcccgcccggucuagccgcggccuguuuggggcuaucgccggauucaucgagggcggcugguccgggcucgucgcgggaugguacggcuuucagcacagcaacgaccaggggaccggaauggccgcugacagagauucuacacaaaaggccauugacaaaaucaccuccaaggugaauaacauuguugauaaaaugaauaagcaguaugaaaucauugaccaugaguucagcgaaaucgagacacggcugaacaugaucaacgauaaaauugacgaucagauccaagacauuugggcuuacaaugccgagcuucuggugcuccuggaaaaccagaagacgcuugaugagcacgacgccaaugucaacaaucuguacaacaaagugaagagagcucucggcucuaaugcgguugaagaugggaagggcuguuuugaccuguaucauaaaugcgacaaccaguguauggagaccauccgcaauggaacauacaaccggagaaaguaucaggaagagagccgccuggagcggcagaaaauugaaggcgugaagcucgaguccgaagggaccuacaaaauccugacaauuuauucuaccgucgccagcucccuugugaucgcuaugggauucgccgccuuucuguucugggcuaugagcaauggcucuugcagaugcaacaucuguauuuga

SEQ ID NO: 193328 - RNA, 1683 nt, Artificial Sequence
  derived and/or modified sequence opt5 from hemagglutinin__InfluenzaA__AGQ81158
auggagguggucaccaucauuacaauccugcucguuauuacgagaagcaacgccgacaagaucugcauuggcuaccaauccaccaauucuacagaaaccguggauacacugaccgagaacaaugugcccgucacacacgcuaaagaacuucugcauaccgagcacaacgggaugcucugugccacgaaucugggacggccucuuauccuggauaccugcacaaucgaaggccucauuuaugggaacccgagcugugaccugccccuggagggacgcgagugguccuacaucguggaaagaccuucugcgguuaauggcgugugcuaucccgggaacgucgagaaucucgaagaacugcggagccuuuucuccucugcuagcuccuaccaacgcauucagaucuuuccugacagcauuuggaacgugucuuauuccggaaccagcaaggccuguucugauuccuucuacagaagcaugcgguggcugacacagaaaaauaacaauuaucccguucaggacgcccaauacaccaacaaucgcggcaagaacauccucuuuauguggggcauuaaccauccuccgacggauacagcucagaccaaucuguacacaagaaccgacaccacaacgucuguggccaccgaggauaucaaccggacauucaaaccccuuaucgggccucgcccccuggucaauggacuccagggcagaauugacuauuacugggcugugcugaagccugggcagacccugcgggugcgcuccaacggaaaucucaucgcccccugguauggccacauucugcuuggggaaagccauggaagaauccugaagacagaucucaaauccggcucuugcgucguucaaugucagaccgagcggggcgggcugaacacgacacuuccguuucacaaugugagcaaguacgcguucggaaacugcccuaaauauauuggcgugaagucccugaaacucgccgucgggcugcgcaaugugcccgcuagaagcucucggggacuguuuggcgccaucgcuggguucaucgaaggaggcugguccggccucguugccgggugguacggauuucagcacagcaacgaccagggcaccgggauggcggccgauagagacucuacccaaaaggcuauugacaagaucacaagcaaagugaauaacauugucgauaagaugaauaaacaguaugagaucauuaaccaugaguucuccgagaucgagacccgccugaauaugaucaacgacaagauugaugaccagauccaagauauuugggccuacaacgcugaacuucuggugcuccuggagaaucagaaaacacuugacgaacacgaugccaacguuaauaaccuguacaauaaggugaaacgggcccucggaucuaacgcugucgaggacggcaagggguguuuugaucuguaucauaagugcgacaaucaguguauggaaacgaucagaaacggcaccuacaaucgccggauguaucaggaggagagcagacuggaacgccagaaaauugagggagugaagcucgaauccgagggcacauacaaaauccugaccauuuauagcacagucgcgucuucccuugugaucgccaugggguucgcugccuuucuguucugggccaugagcaacggaucuugccggugcaauaucuguauuuga

SEQ ID NO: 193329 - RNA, 1683 nt, Artificial Sequence
  derived and/or modified sequence opt5 from hemagglutinin__InfluenzaA__AGQ81159
auggaggccgcuaccaucauuacaauccugcucgugauuacgggcagcaacgccgacaagaucugcauuggguaccaguccaccaauucuacagaaaccgucgauacacugaccgagaacaauguucccgugacacacgcgaaagaacuucugcauaccgagcacaacggaaugcucugugcuacgaaucugggcagaccucuuauccuggauaccugcacaaucgaagggcucauuuauggaaacccgagcugugaccugccccuggagggccgggacugguccuacaucguggagcgcccuucugccgucaauggggugugcuaucccggaaacguugaaaaucucgaggaacugagaagccuuuucuccucugccagcuccuaccaaaagauucagaucuuuccugauagcauuuggaacgugucuuaugacggcaucuccaaagccuguagcaauucuuucuaccgguccaugcgcuggcugaccaagaaaaacaauagcuaucccguccaggaugcucaguacacaaacaauauuggcaagaacauccucuuuaugugggggaucaaccauccuccgaccaauacgacacaaaccgaccuguacacaagaaccgauaccacaacgucuguggcuaccgaggacauucaccggacauucaagccccuuaucggaccucggcccccuguuaacggccugcucgggagaauugauuauuacugggccgugcugaaacccggacagacccugcggguccgcuccaauggcaaccucaucgcgccgugguaugggcauauucugcuuggagagagccacggcagaauccugaagacagaccucaaauccggcaauugcguggugcagugucagaccgaacgcgggggacugaacacgacacuuccuuuucacaaugucucuaaguacgccuucggcaacugccccaaauauaucgggguuaagagccugaagcucgcugugggacugcgcaaugugccugccagauccagccggggccuguuuggggcuauugccggauucaucgagggcggcuggucugggcucgucgcgggaugguacggcuuucaacauuccaacgaucaggggaccggaauggccgcugaccgcgacagcacccagaaagccauugauaagaucacaucuaaagugaauaacauuguugacaagaugaauaaacaguaugaaaucaucgaucacgaguucagcgaaauugagaccagacugaacaugaucaaugacaagauugaugaccaaauccaggauauuugggcuuacaacgccgagcuucuggugcuccuggaaaaccagaaaacacuugacgagcaugaugccaaugucaacaaucuguacaacaaggugaagcgggcucucggcuccaaugcgguugaagacgggaaaggcuguuuugaucuguaucacaagugcgacaaccaauguauggagacgaucagaaauggaaccuacaaccgccggaaauaucaggaagagucuagacuggagcgccagaagauugaaggcgugaaacucgagagcgaagggacauacaagauccugaccaucuauuccacagucgccagcucucuugugauugcuaugggauucgccgccuuucuguucugggcuauguccaauggcagcugccggugcaacaucuguauuuga

SEQ ID NO: 193330 - RNA, 1683 nt, Artificial Sequence
  derived and/or modified sequence opt5 from hemagglutinin__InfluenzaA__AGQ81161
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugacccccugcucgagggaagagaguggagcuacaucguggaacggccuuccgcuguuaacggccugugcuaucccgggaauguggagaaccuugaggaacugcgcucucucuucagcuccgccagaagcuaccagcggauucagaucuuuccugacaccauuuggaaugucucuuaugauggaacauccaaggccuguagcggcucuuucuaccgcaacaugagauggcugacccagaaaaauuccgacuaucccauccaagaugcucaguacacgaacaaucagggcaagaacauucuuuuuaugugggggaucaaucauccuccgacagacaccacacagcgggaucuguacacccgcaccgacacaacgaccagcguggccacagaggaaauuaacagaaucuucaaaccccucaucggaccucggccccugguuaacggccugauggggcgcauugauuauuacuggucugugcucaagccuggacaaacccugagaaucaaguccgacggcaaucuuauugcucccugguaugggcacauccugagcggagagucccauggccggauucucaaaacagaucugaagaaaggcucuugcaccguccagugucagacggaaaaagggggacuuaacacaacccugccguuucagaaugugagcaaguacgccuucggcaacugcuccaaguauaucgggaucaagagccucaaacuggcggugggacugcgcaaugucccuucuagauccagccggggccucuuuggggccauugcuggauucaucgagggcggcuggucugggcugguugccggaugguacggcuuucaacacagcaacgaccagggggugggaauggcugccgaccgcgauuccacccagaaggcgauugacaaaaucacaucuaaggugaauaacauugucgauaaaaugaauaagcaauaugaaaucaucgaccacgaguucagcgagguggaaaccagacuuaacaugauuaauaacaaaaucgaugaccagauucaggauaucugggccuacaaugcugagcugcucguucugcuugaaaaccagaagacacuggacgagcaugaugccaaugugaacaaccucuacaauaaggucaaacgggcucugggcuccaacgccguggaagacgggaagggcuguuuugagcuguaucacaaaugcgaugaccaauguauggagacgauuagaaauggaaccuacaaccgccggaaguaucaggaagagagcaaacucgaaagacagaagaucgagggcguuaagcuggaaucugaggggacauacaaaauucuuaccaucuauuccacaguggccagcucucuggucaucgcuaugggauucgcggccuuucucuucugggcuauguccaauggcagcugccgcugcaacauuuguaucuga

SEQ ID NO: 193331 - RNA, 1683 nt, Artificial Sequence
  derived and/or modified sequence opt5 from hemagglutinin__InfluenzaA__AGQ81162
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuaugauggaacauccaaggccuguagcggcucuuucuaccgcuccaugagauggcuuacccagaaaaacagcgacuauccuauccaagaugcucaguacacgaauaaccagggcaagaauauucuguuuaugugggggaucaaccaucccccuacagacaccacacagcgggaucucuacacccgcaccgacacaacgaccucuguggccacagaggaaauuaauagaaucuucaaaccgcugaucggaccccggccucugguuaacggccucauggggcgcauugauuauuacugguccgugcugaagcccggacaaacccuuagaaucaagagcgacggcaaccugauugcuccuugguaugggcacauccucuccggagagucucauggccggauucugaaaacagaucuuaagaaaggcagcugcaccguccagugucagacggaaaaagggggacugaauacaacccuccccuuucagaacguguccaaguacgccuucggcaauugcagcaaguauaucgggaucaagucucugaaacuggcggugggacuccgcaacgucccguccagaagcucucggggccuguuuggggccauugcuggauucaucgagggcggcuggagcgggcuuguugccggaugguacggcuuucaacacuccaaugaccagggggugggaauggcugccgaccgcgauucuacccagaaggcgauugacaaaaucacaagcaaggugaacaauauugucgauaaaaugaacaagcaauaugaaaucaucgaccacgaguucuccgagguggaaaccagacugaauaugauuaacaauaaaaucgaugaccagauucaggauaucugggccuacaacgcugagcuccugguucuucuggaaaaucagaagacacucgacgagcaugaugccaacgugaauaaccuguacaacaaggucaaacgggcucugggcagcaaugccguggaagacgggaagggcuguuuugagcucuaucacaaaugcgaugaccaauguauggagacgauuagaaacggaaccuacaaucgcaagaaauaucaggaagagucuaagcuggaacggcagaagaucgagggcguuaaacuugaauccgaggggacauacaagauucugaccaucuauagcacaguggccucuucccucgucaucgcuaugggauucgcggccuuucuguucugggcuaugagcaacggcuccugcagaugcaauauuuguaucuga

SEQ ID NO: 193332 - RNA, 1683 nt, Artificial Sequence
  derived and/or modified sequence opt5 from hemagglutinin__InfluenzaA__AGQ81164
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuaugauggaacauccaaggccuguagcggcucuuucuaccgcuccaugagauggcuuacccagaaaaacagcgacuauccuauccaagaugcucaguacacgaauaaccagggcaagaauauucuguuuaugugggggaucaaccaucccccuacagacaccacacagcgggaucucuacacccgcaccgacacaacgaccucuguggccacagaggaaauuaauagaaucuucaaaccgcugaucggaccccggccucugguuaacggccucauggggcgcauugauuauuacugguccgugcugaagcccggacaaacccuuagaaucaagagcgacggcaaccugauugcuccuugguaugggcacauccucuccggagagucucauggccggauucugaaaacagaucuuaagaaaggcagcugcaccguccagugucagacggaaaaagggggacugaauacaacccuccccuuucagaacguguccaaguacgccuucggcaauugcagcaaguauaucgggaucaagucucugaaacuggcggugggacuccgcaacgucccguccagaagcucucggggccuguuuggggccauugcuggauucaucgagggcggcuggagcgggcuuguugccggaugguacggcuuucaacacuccaaugaccagggggugggaauggcugccgaccgcgauucuacccagaaggcgauugacaaaaucacaagcaaggugaacaauauugucgauaaaaugaacaagcaauaugaaaucaucgaccacgaguucuccgagguggaaaccagacugaauaugauuaacaauaaaaucgaugaccagauucaggauaucugggccuacaacgcugagcuccugguucuucuggaaaaucagaagacacucgacgagcaugaugccaacgugaauaaccuguacaacaaggucaaacgggcucugggcagcaaugccguggaagacgggaagggcuguuuugagcucuaucacaaaugcgaugaccaauguauggagacgauuagaaacggaaccuacaaucgccggaaguaucaggaagagucuaaacuggaaagacagaagaucgagggcguuaaacuugaauccgaggggacauacaagauucugaccaucuauagcacaguggccucuucccucgucaucgcuaugggauucgcggccuuucuguucugggcuaugagcaacggcuccugccgcugcaauauuuguaucuga

SEQ ID NO: 193333 - RNA, 1683 nt, Artificial Sequence
  derived and/or modified sequence opt5 from hemagglutinin__InfluenzaA__AGQ81167
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauaacggaacauccaaggccuguagcggcucuuucuaccgcuccaugagauggcuuacccagaaaaauagcaacuauccuauccaagaugcucaguacacgaauaaccagggcaagaauauucuguuuaugugggggaucaaccaucccccuacagacaccacacagcgggaucucuacacccgcaccgacacaacgaccucuguggccacagaggaaauuaacagaaucuucaaaccgcugaucggaccccggccucugguuaauggccucauggggcgcauugauuauuacugguccgugcugaagcccggacaaacccuuagaaucaagagcgacggcaaccugauugcuccuugguaugggcacauccucuccggagagucucauggccggauucugaaaacagaucuuaagaaaggcagcugcaccguccagugucagacggaaaaagggggacugaauacaacccuccccuuucagaacguguccaaguacgccuucggcaauugcagcaaguauaucgggaucaagucucugaaacuggcggugggacuccgcaacgucccguccagaagcucucggggccuguuuggggccauugcuggauucaucgagggcggcuggagcgggcuuguugccggaugguacggcuuucaacacuccaaugaccagggggugggaauggcugccgaucgcgacucuacccagaaggcgauugacaaaaucacaagcaaggugaacaauauugucgauaaaaugaacaagcaauaugaaaucaucgaccacgaguucuccgagguggaaaccagacugaauaugauuaacaauaaaaucgaugaccagauucaggauaucugggccuacaacgcugagcuccugguucuucuggaaaaucagaagacacucgacgagcaugaugccaacgugaacaaucuguacaacaaggucaaacgggcucugggcagcaaugccguggaagacgggaagggcuguuuugagcucuaucacaaaugcgaugaccaauguauggagacgauuagaaacggaaccuacaaucgccggaaguaucaggaagagucuaaacuggaaagacagaagaucgagggcguuaaacuugaauccgaggggacauacaagauucugaccaucuauagcacaguggccucuucccucgucaucgcuaugggauucgcggccuuucuguucugggcuaugagcaacggcuccugccgcugcaauauuuguaucuga

SEQ ID NO: 193334 - RNA, 1683 nt, Artificial Sequence
  derived and/or modified sequence opt5 from hemagglutinin__InfluenzaA__AGQ81168
auggagaccgugagccugaucacaauucuccuggucguuacgguguccaacgccgacaagaucugcauuggcuaccagucuaccaauagcacagaaaccguggauacacuuaccgagaacaauguccccgugacacacgcuagagaacugcuccauaccgagcacaacgggaugcugugugccacgucccuuggacauccucugauccucgauaccugcacaauugaaggccugaucuaugggaauccgucuugugaccugcuccugggaggccgggaguggagcuacaucguugagcgccccuccgcggugaacgggcuuugcuauccuggaaaugucgaaaaccuggaggaacucagaucucuguucagcuccgcucggagcuaccaacgcauucagaucuuucccgacaccauuuggaaugugucuuauuccggcacaagcaaagccuguucugauuccuucuacagaagcaugcgguggcuuacccagaagggcaacgccuauccuauccaggacgcucaauacacgaauaaccaggggaaaaauauucuguuuauguggggaaucaaccaucccccuacagauaccgcccagacaaaucucuacacccgcaccgacacaacgaccucuguugcuacagaggagauuaacagaaccuucaagccgcugaucggcccccggccucuggugaacgggcucaugggacgcaucaauuauuacugguccguccugaaacccggccagacacuuagaauuaagagcaacgggaaucugaucgccccuugguauggacacauucucuccggcgaaucucacggccggauccugaagaccgaucuuaaacgcgggagcugcacggugcaaugucagacagagaagggaggccugaacaccacccuccccuuucagaauguguccaaauacgcguucgggaacugcagcaaguauauuggaaugaaaucucugaagcuggccgucggccucagaaauguuccgucccggagcucucgcgggcuguuuggagcuaucgccggcuucaucgaaggcggguggagcggacuuguggcuggcugguacggguuucagcacuccaacgaccaaggagugggcauggccgcggauagagacucuacacagaaggccauugauaaaaucaccagcaaggucaauaacauuguggacaaaaugaauaagcaguaugagaucauugaccaugaguucuccgaaguugagacacggcugaacaugaucaauaacaaaaucgaugaccaaauucaggauaucugggcuuacaaugccgaacuccuggugcuucuggagaaccagaagacgcucgacgaacacgaugcuaacgucaauaaccuguacaauaaagugaagagagcccuggggagcaacgccguugaggacggcaagggauguuuugaacucuaucauaaaugcgaugaccaguguauggagaccauucgcaauggcacauacaaccggagaaaguaucaagaggaaucuaaacuggagcgccagaagaucgaaggggugaaacuugaguccgaaggaaccuacaagauucugacaaucuauagcaccgucgcuucuucccucgugauugcgaugggcuucgccgcuuuucuguucugggccaugagcaauggguccugccggugcaacaucuguaucuga

SEQ ID NO: 193335 - RNA, 1683 nt, Artificial Sequence
  derived and/or modified sequence opt5 from hemagglutinin__InfluenzaA__AGQ81169
auggagaccgugagccugaucacaauucuccuggucguuacgguguccaacgccgacaagaucugcauuggcuaccagucuaccaauagcacagaaaccguggauacacuuaccgagaacaauguccccgugacacacgcuagagaacugcuccauaccgagcacaacgggaugcugugugccacgucccuuggacauccucugauccucgauaccugcacaauugaaggccugaucuaugggaauccgucuugugaccugcuccugggaggccgggaguggagcuacaucguugagcgccccuccgcggugaacgggcuuugcuauccuggaaaugucgaaaaccuggaggaacucagaucucuguucagcuccgcucggagcuaccaacgcauucagaucuuucccgacaccauuuggaaugugucuuauuccggcacaagcaaagccuguucugauuccuucuacagaagcaugcgguggcuuacccagaaggacaacgccuauccuauccaggaugcucaauacacgaauaaccaggagaaaaauauucuguuuauguggggcaucaaccaucccccuacagacaccguucagacaaaucucuacacccgcaccgauacaacgaccucuguggccacagaggaaauuaacagaaccuucaagccgcugaucgggccccggccucuggucaacggacucaugggccgcaucaauuauuacugguccgugcugaaacccgggcagacacuuagaauuaagagcaacggaaaucugaucgcuccuugguauggccacauucucuccggggagucucacggacggauccugaagaccgaccuuaaacgcggcagcugcacggugcaaugucagacagaaaagggcgggcugaacaccacccuccccuuucagaaugucuccaaauacgccuucggaaacugcagcaaguauauuggcaugaaaucucugaagcuggcgguugggcucagaaaugugccgucccggagcucucgcggacuguuuggcgccaucgcuggguucaucgagggaggcuggagcggccuuguggccgggugguacggauuucagcacuccaacgaucaaggcgucgggauggcugccgacagagauucuacacagaaggcgauugacaaaaucaccagcaaggugaauaacauuguugacaaaaugaauaagcaguaugaaaucauugaucaugaguucuccgagguggaaacacggcugaacaugaucaauaacaaaaucgacgaucaaauucaggacaucugggccuacaaugcugagcuccugguccuucuggaaaaccagaagacgcucgaugagcacgacgccaacgugaauaaccuguacaauaaaguuaagagagcucugggaagcaacgccguggaagauggcaagggguguuuugagcucuaucauaaaugcgacgaucaguguauggagaccauucgcaauggcacauacaaccggagaaaguaucaagaagagucuaaacuggaacgccagaagaucgagggagucaaacuugaauccgagggcaccuacaagauucugacaaucuauagcaccguggccucuucccucgucauugcuaugggguucgcggccuuucuguucugggcuaugagcaauggauccugccggugcaacaucuguaucuga

SEQ ID NO: 193336 - RNA, 1683 nt, Artificial Sequence
  derived and/or modified sequence opt5 from hemagglutinin__InfluenzaA__AGQ81170
auggagaccgugagccugaucacaauucuccuggucguuacgguguccaacgccgacaagaucugcauuggcuaccagucuaccaauagcacagaaaccguggauacacuuaccgagaacaauguccccgugacacacgcuagagaacugcuccauaccgagcacaacgggaugcugugugccacgucccuuggacauccucugauccucgauaccugcacaauugaaggccugaucuaugggaauccgucuugugaccugcuccugggaggccgggaguggagcuacaucguugagcgccccuccgcggugaacgggcuuugcuauccuggaaaugucgaaaaccuggaggaacucagaucucuguucagcuccgcucggagcuaccaacgcauucagaucuuucccgacaccauuuggaaugugucuuauuccggcacaagcaaagccuguucugauuccuucuacagaagcaugcgguggcuuacccagaaggacaacgccuauccuauccaggaugcucaauacacgaauaaccagggcaaaaauauucuguuuaugugggggaucaaccaucccccuacagacaccgcccagacaaaucucuacacccgcaccgauacaacgaccucuguugcuacagaggagauuaacagaaccuucaagccgcugaucggaccccggccucuggugaacggccucauggggcgcaucaauuauuacugguccguccugaaacccggacagacacuuagaauuaagagcaacggcaaucugaucgccccuugguaugggcacauucucuccggagaaucucacggccggauccugaagaccgaccuuaaacgcggcagcugcacggugcaaugucagacagagaaagggggacugaacaccacccuccccuuucagaauguguccaaguacgcguucggcaacugcagcaaguauauugggaugaaaucucugaagcuggccgucggacucagaaauguuccgucccggagcucucgcggccuguuuggggcuaucgccggauucaucgaaggcggcuggagcgggcuuguggcuggaugguacggcuuucagcacuccaacgaucaaggggugggaauggccgcggacagagauucuacacagaaggccauugacaaaaucaccagcaaggucaauaacauuguggacaaaaugaauaagcaguaugagaucauugaucaugaguucuccgaaguugagacacggcugaacaugaucaauaacaaaaucgacgaucaaauucaggacaucugggcuuacaaugccgaacuccuggugcuucuggagaaccagaagacgcucgaugaacacgacgcuaacgucaauaaccuguacaauaaagugaagagagcccugggcagcaacgccguugaggaugggaagggcuguuuugaacucuaucauaaaugcgacgaucaguguauggagaccauucgcaauggaacauacaaccggagaaaguaucaagaggaaucuaaacuggagcgccagaagaucgaaggcgugaaacuugaguccgaagggaccuacaagauucugacaaucuauagcaccgucgcuucuucccucgugauugcgaugggauucgccgcuuuucuguucugggccaugagcaauggcuccugccggugcaacaucuguaucuga

SEQ ID NO: 193337 - RNA, 1683 nt, Artificial Sequence; identical to SEQ ID NO: 193336
  derived and/or modified sequence opt5 from hemagglutinin__InfluenzaA__AGQ81171

SEQ ID NO: 193338 - RNA, 1683 nt, Artificial Sequence; identical to SEQ ID NO: 193336
  derived and/or modified sequence opt5 from hemagglutinin__InfluenzaA__AGQ81172

SEQ ID NO: 193339 - RNA, 1683 nt, Artificial Sequence
  derived and/or modified sequence opt5 from hemagglutinin__InfluenzaA__AGQ81173
auggagaccgccagccugaucacaauucuccugguggucacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggaaauccucugauccucgauaccugcacaauugaaggccugaucuaugggaacccgucuugugaccugcuccugggaggcagagaguggagcuacaucguggagcggcccuccgcuguuaaugggcuuugcuauccuggaaacguggaaaaucuggaggaacuccgcucucuguucagcuccgccagaagcuaccaacggauucagaucuuucccgacaccauuuggaacgucucuuauuccggcacaagcaaggccuguucugauuccuucuaccgcagcaugagauggcuuacccagaaagacaaugcuuauccuauccaggaugcccaauacacgaacaaucagggcaagaacauucuguuuaugugggggaucaaucaucccccuacagacaccgcucagacaaaccucuacacccggaccgauacaacgaccucuguggccacagaggagauuaaccgcaccuucaaaccgcugaucggacccagaccucugguuaauggccucauggggcggaucaacuauuacugguccgugcugaagcccggacagacacuucgcauuaagagcaauggcaaccugaucgcgccuugguaugggcacauucucuccggagaaucucauggcagaauccugaaaaccgaccuuaagcggggcagcugcacgguccaaugucagacagagaaagggggacugaauaccacccuccccuuucagaacguguccaaguacgccuucggcaauugcagcaaauauauugggaugaagucucugaagcuggcugugggacuccgcaacgucccguccagaagcucucggggccuguuuggggccaucgcuggauucaucgaaggcggcuggagcgggcuuguugccggaugguacggcuuucagcacuccaaugaucaaggggugggaauggcggccgaccgcgauucuacacagaaagcuauugacaagaucaccagcaaagugaacaauauugucgacaagaugaacaaacaguaugagaucauugaucacgaguucuccgaaguggagacaagacugaauaugaucaacaauaagaucgacgaucaaauucaggacaucugggccuacaacgcugaacuccugguucuucuggagaaccagaaaacgcucgaugaacaugacgccaaugugaacaaucuguacaacaaggucaagcgggcccugggcagcaaugcuguggaggaugggaaaggcuguuuugaacucuaucacaagugcgacgaucaguguauggagaccauuagaaacggaacauacaaucgccggaaauaucaagaggaaucuaagcuggagagacagaaaaucgaaggcguuaaacuugaguccgaagggaccuacaagauucugacaaucuauagcaccguggcgucuucccucgucauugccaugggauucgcugccuuucuguucugggccaugagcaacggcuccugccgcugcaauaucuguaucuga

SEQ ID NO: 193340 - RNA, 1683 nt, Artificial Sequence; identical to SEQ ID NO: 193336
  derived and/or modified sequence opt5 from hemagglutinin__InfluenzaA__AGQ81175

SEQ ID NO: 193341 - RNA, 1683 nt, Artificial Sequence
  derived and/or modified sequence opt5 from hemagglutinin__InfluenzaA__AGQ81177
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauaacggaacauccaaggccuguagcggcucuuucuaccgcuccaugagauggcuuacccggaaaaauggcgauuauccuauccaggacgcucaauacacgaacaaucaggggaagaacauucuguuuauguggggaaucaaucaucccccuacagauaccacacagcgcgaccucuacaccagaaccgauacaacgaccagcguggccacagaggaaauuaaccggaucuucaaaccgcugaucggcccccgcccucugguuaacgggcucaugggaagaauugacuauuacuggucugugcugaagcccggccagacccuucggaucaaguccgaugggaaucugauugcuccuugguauggacacauccucagcggcgagucccauggccgcauucugaaaacagaccuuaagagagggucuugcaccguccaaugucagacggaaaaaggaggccugaacacaacccuccccuuucagaaugugagcaaguacgccuucgggaacugcuccaaauauaucggaaucaagagccugaagcuggcggugggccuccggaaugucccgucucgcuccagcagagggcuguuuggagccauugcuggcuucaucgagggcggguggucuggacuuguugccggcugguacggguuucagcacagcaacgaucaaggagugggcauggcugccgaccgggacuccacccagaaagcgauugauaagaucacaucuaaagugaauaacauugucgacaagaugaauaaacaguaugaaaucaucgaucacgaguucagcgagguggaaaccagacugaacaugauuaauaacaagaucgacgaucaaauucaggacaucugggccuacaaugcugagcuccugguucuucuggaaaaccagaaaacacucgaugagcaugacgccaaugugaacaaccuguacaauaaggucaagcgcgcucugggguccaacgccguggaagauggcaaaggauguuuugagcucuaucacaagugcgacgaucaguguauggagacgauucggaauggcaccuacaacagacgcaaauaucaagaagagagcaagcuggaacggcagaaaaucgaggggguuaaacuugaaucugagggaacauacaagauucugaccaucuauuccacaguggccagcucucucgucaucgcuaugggcuucgcggccuuucuguucugggcuauguccaaugggagcugcagaugcaacauuuguaucuga

SEQ ID NO: 193342 - RNA, 1683 nt, Artificial Sequence; identical to SEQ ID NO: 193341
  derived and/or modified sequence opt5 from hemagglutinin__InfluenzaA__AGQ81178

SEQ ID NO: 193343 - RNA, 1683 nt, Artificial Sequence; identical to SEQ ID NO: 193333
  derived and/or modified sequence opt5 from hemagglutinin__InfluenzaA__AGQ81181

SEQ ID NO: 193344 - RNA, 1683 nt, Artificial Sequence; identical to SEQ ID NO: 193333
  derived and/or modified sequence opt5 from hemagglutinin__InfluenzaA__AGQ81183

SEQ ID NO: 193345 - RNA, 1683 nt, Artificial Sequence; identical to SEQ ID NO: 193332
  derived and/or modified sequence opt5 from hemagglutinin__InfluenzaA__AGQ81184

SEQ ID NO: 193346 - RNA, 1683 nt, Artificial Sequence
  derived and/or modified sequence opt5 from hemagglutinin__InfluenzaA__AGQ81185
auggagaccgccagccugaucacaauucuccugguggcuacggucuccaacgccgacaagaucugcauuggcuaccagucuaccaauagcacagaaaccguugauacacuuaccgagaacaaugugcccgugacacacgcgaaggaacugcuccauaccgagcacaacgggaugcugugugcuacgucccuuggacaaccucugauccucgauaccugcacaauugaaggccugaucuaugggaauccgucuugugaccugcuccuggagggaagagaguggagcuacaucgucgaacggcccuccgccgugaacggccuuugcuauccugggaauguugagaaccuggaggaacuccgcucucuguucagcuccgccagaagcuaccagcggauucagaucuuucccgacaccacauggaaugugucuuauaacggaaccuccaaggcuuguagcggcucuuucuaccgcuccaugagauggcuuacgcagaaaaauagcaacuauccuauucaagaugcccaguacacaaauaaccagggcaagaauauccuguuuaugugggggauuaaccaucccccuaccgacacaacccagcgggaucucuacacccgcacagacacgaccacaucugucgcuaccgaggaaaucaacagaauuuucaaaccgcugaucggaccccggccucuggugaauggccucauggggcgcaucgauuauuacugguccguucugaagcccggacaaacacuuagaauuaagagcgacggcaaccugaucgccccuugguaugggcacauucucuccggagagucucauggccggauccugaaaaccgaucuuaagcgcggcagcugcacggugcagugucagacagaaaaagggggacugaauaccacccuccccuuucagaacgucuccaaguacgcguucggcaauugcagcaaauauauugggaucaagucucugaagcuggccgugggacucagaaacgugccgucccggagcucucgcggccuguuuggggcuaucgccggauucauugagggcggcuggagcgggcuugucgcuggaugguacggcuuucaacacuccaaugaccaggggguuggaauggccgcggauagagacucuacacagaaagccaucgacaagauuaccagcaaagugaacaauaucguggauaagaugaacaaacaauaugaaauuaucgaccacgaguucuccgaggucgaaacacggcugaauaugaucaacaauaagauugaugaccagauccaggauauuugggcuuacaacgccgagcuccuggugcuucuggaaaaucagaaaacgcucgacgagcaugaugcuaacguuaacaaucuguacaacaaggugaagagagcccugggcagcaaugccgucgaagacgggaaaggcuguuuugagcucuaucacaagugcgauaaccaauguauggagaccauccgcaauggaacauacaaccggagaaaauaucaggaagagucuaagcuggaacgccagaaaauugagggcgugaaacuugaauccgaggggaccuacaagauccugacaauuuauagcaccguugcuucuucccucgugaucgcgaugggauucgccgcuuuucuguucugggccaugagcaauggcuccugccggugcaacaucuguauuuga

SEQ ID NO: 193347 - RNA, 1683 nt, Artificial Sequence
  derived and/or modified sequence opt5 from hemagglutinin__InfluenzaA__AGQ81186
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuaugauggaacauccaaggccuguagcggcucuuucuaccgcuccaugagauggcuuacccagaaaaacagcgacuauccuauccaagaugcucaguacacgaauaaccagggcaagaauauucuguuuaugugggggaucaaccaucccccuacagacaccacacagcgggaucucuacacccgcaccgacacaacgaccucuguggccacagaggaaauuaauagaaucuucaaaccgcugaucggaccccggccucugguuaacggccucauggggcgcauugauuauuacugguccgugcugaagcccggacaaacccuuagaaucaagagcgacggcaaccugauugcuccuugguaugggcacauccucuccggagagucucauggccggauucugaaaacagaucuuaagaaaggcagcugcaccguccagugucagacggaaaaagggggacugaauacaacccuccccuuucagaacguguccaaguacgccuucggcaauugcagcaaguauaucgggaucaagucucugaaacuggcgauuggacuccgcaacgugccguccagaagcucucggggccuguuuggggccaucgcuggauucauugagggcggcuggagcgggcuugucgccggaugguacggcuuucaacacuccaaugaccaggggguuggaauggcugccgaccgcgauucuacccagaaggcgaucgacaaaauuacaagcaaggugaacaauaucguggauaaaaugaacaagcaauaugaaaucauugaccacgaguucuccgaggucgaaaccagacugaauaugaucaacaauaaaauugaugaccagauccaggauauuugggccuacaacgcugagcuccuggugcuucuggaaaaucagaagacacucgacgagcaugaugccaacguuaauaaccuguacaacaaggugaaacgggcucugggcagcaaugccgucgaagacgggaagggcuguuuugagcucuaucacaaaugcgaugaccaauguauggagacgaucagaaacggaaccuacaaucgcaagaaauaucaggaagagucuaagcuggaacggcagaagauugagggcgugaaacuugaauccgaggggacauacaagauccugaccaucuauagcacaguugccucuucccucgugauugcuaugggauucgcggccuuucuguucugggcuaugagcaacggcuccugcagaugcaauaucuguauuuga

SEQ ID NO: 193348 - RNA, 1683 nt, Artificial Sequence; identical to SEQ ID NO: 193336
  derived and/or modified sequence opt5 from hemagglutinin__InfluenzaA__AGQ81190

SEQ ID NO: 193349 - RNA, 1683 nt, Artificial Sequence; identical to SEQ ID NO: 193336
  derived and/or modified sequence opt5 from hemagglutinin__InfluenzaA__AGQ81191

SEQ ID NO: 193350 - RNA, 1683 nt, Artificial Sequence; identical to SEQ ID NO: 193341
  derived and/or modified sequence opt5 from hemagglutinin__InfluenzaA__AGQ81192

SEQ ID NO: 193351 - RNA, 1683 nt, Artificial Sequence
  derived and/or modified sequence opt5 from hemagglutinin__InfluenzaA__AGQ81193
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaggaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauacaggaaccuccaaggccuguagcggcucuuucuaccgcuccaugagauggcuuacgcagaaaaacggcgauuauccuauccaagacgcucaguacacaaauaaccaggggaagaauauucuguuuauguggggaaucaaccaucccccuaccgauacaacccagcgggaccucuacacccgcacagauacgaccacaagcguggccaccgaggaaauuaauagaaucuucaaaccgcugaucggcccccggccucugguuaacgggcucaugggacgcauugacuauuacuggucugugcugaagcccggccaaacacuuagaaucaaguccgaugggaaccugauugcuccuugguauggacacguccucagcggcgagucccauggccggauccugaaaaccgaccuuaagcgcgggucuugcacggugcagugucagacagaaaaaggaggccugaauaccacccuccccuuucagaacgugagcaaguacgccuucgggaauugcuccaaauauauuggaaucaagagccugaagcuggcggucggccucagaaacguuccgucucgguccagccgcgggcuguuuggagccaucgcuggcuucauugagggcggguggucuggacuuguggccggcugguacggguuucaacacagcaaugaucagggagugggcauggcugccgacagagacuccacacagaaagcgaucgauaagauuaccucuaaagucaacaauaucguggacaagaugaacaaacaauaugaaauuaucgaucacgaguucagcgagguugaaacacggcugaauaugaucaacaauaagauugacgaucagauccaggacauuugggccuacaacgcugagcuccuggugcuucuggaaaaucagaaaacgcucgaugagcaugacgccaacgucaauaaccuguacaacaaggugaagagagcucugggguccaaugccguugaagauggcaaaggauguuuugagcucuaucacaagugcgacgaucaauguauggagaccauccgcaacggcacauacaaucggagaaaauaucaggaagagagcaagcuggaacgccagaaaauugagggggugaaacuugaaucugagggaaccuacaagauccugacaauuuauuccaccgucgccagcucucucgugaucgcuaugggcuucgcggccuuucuguucugggcuauguccaacgggagcugccggugcaauaucuguauuuga

SEQ ID NO: 193352 - RNA, 1683 nt, Artificial Sequence; identical to SEQ ID NO: 193336
  derived and/or modified sequence opt5 from hemagglutinin__InfluenzaA__AGQ81194

SEQ ID NO: 193353 - RNA, 1686 nt, Artificial Sequence
  derived and/or modified sequence opt5 from hemagglutinin__InfluenzaA__AGQ81195
auguacaagaucguggucauuaucacccugcucggcacaguuaaagggcuggacaagauuugccuuggacaccaugccguggcuaacggcacgaucgugaaaacccugacaaaugagcaggaagaggucaccaacgccacagaaaccguggaggggaaaagccucaauagacuguguaugaaaggacggaaccacaaggaucuuggcaauugccaucccauugggaugcugaucggaaccccugcgugugaccuccaccugacaggcacgugggauacccugaucgaacgcgagaacgcuauugccuauugcuacccgggcgccacaaucaaugaggaagcucucagacaaaagauuauggaguccgggggaaucucuaaaauuagcaccggcuucacauauggguccucuaucaacagcgccggaaccacgcgggcuuguaugcgcaauggcgggaacuccuuuuacgccgaacugaaguggcuuguuucuaaaagcaagggacagaauuucccccagacaaccaacacauauagaaauaccgacaccuccgagcaucugauuauguggggcauccaccacccuagcucuacacaggagaaaaacgaucucuacggcacgcaaucccugagcaucucugugggguccagcaccuaucagaauaacuuuguccccgugguuggagcgcggccucaggugaacggccagucugggcgcauugacuuccauuggacacuuguccaacccggagauaauaucaccuuuucccacaacggcgggcugauugccccuagcagaguguccaagcucaucggacggggccugggcauucagucugacgcuagcaucgauaauaacugcgaauccaaguguuucuggcgcgggggaagcaucaauacaagacugccguuucagaaccucucuccccggaccgugggccagugcccuaaauacgucaauaagcgcucccugaugcuugccacggggaugagaaacguucccgagauuaugcaaggacggggccuguucggggcuaucgccggcuuuauugaaaauggaugggagggcaugguggacgggugguacggauuccgccaucagaacgcgcagggcacagggcaagccgcugauuauaaaagcacccaggccgcuaucgaccagauuaccggaaagcucaauagacugaucgaaaagacaaacaccgaguuugagucuaucgaaagcgaguucuccgaaauugagcaccagaucggcaaugugauuaacuggacaaaggauucuaucacggacauuuggaccuaccaagccgaacuucuggucgccauggagaaucagcacacaaucgacauggcugauagcgagaugcucaaccuguaugaacgggugagaaaacagcugcgccagaacgcggaggaagacgggaagggcuguuuugagauuuaccaugccugcgaugacuccuguauggaaagcauccggaauaacaccuaugaucacucucaauacagagaggaggcucuccugaaucgccuuaacaucaauccuguuacacuguccagcggauauaaggacauuauccucugguucucuuucggcgccuccugcuuugugcugcuugccgucgugauggggcugguuuucuuuugccucaaaaacggaaauaugcgguguaccauuugcaucuga

SEQ ID NO: 193354 - RNA, 1686 nt, Artificial Sequence
  derived and/or modified sequence opt5 from hemagglutinin__InfluenzaA__AGQ81196
auguacaagaucguggucauuaucgcccugcucggcgcuguuaaagggcuggacaagauuugccuuggacaccaugccguggcgaacggcaccaucgugaaaacacugacgaaugagcaggaagaggucaccaacgcuacagaaaccguggagagcgccucccucaauagacuguguaugaaggggcggucucacaaagaucuuggaaacugccaucccauuggcaugcugaucgggaccccugccugugaccuccaccugacaggaacaugggauacccugaucgaacgcgagaaugcuauugccuauugcuacccgggcgcuacgguuaacgaggaagcccucagacaaaagaucauggagagcggcgggauuuccaagaucucuaccggauucacauauggcagcuccauuaauucugcggggaccacaaaagccuguaugcggaaccgcggaaauagcuuuuacgcugaacugaaguggcuuguguccaaaagcaagggccagaacuucccccagaccacgaauacauauagaaacaccgacacagccgagcaucugaucaugugggggauucaccacccuucuuccacccaggagaaaaaugaucucuacggaacccaaagccugucuaucuccgucggcagcucuacauaucagaacaauuuugugcccguugugggcgcucggccucaggucaacgggcaguccggacgcaucgacuuccauuggacgcuugugcaacccggcgauaacauuaccuuuagccacaaugggggacugaucgccccuuccagagugucuaagcucgucggccgggggcugggcauucagagcgacgcgccgaucgauaacaauugcgaauccaaguguuucuggcgcggaggcagcauuaacacaagacugcccuuucagaaucucucuccucggaccguugggcagugccccaaauacgugaacaagcgcucccugaugcuugccacaggaaugagaaaugugccugagaucaugcaaggccgggggcuguucggagcuaucgccggcuuuauugaaaacgggugggagggcauggucgacggaugguacggcuuccgccaucagaaugcucaggggaccggacaagccgccgauuauaaaagcacgcagacagcuaucgaccagauuaccggcaagcucaacagacugaucgagaaaaccaauacagaauuugagucuauugaaagcgaguucuccgaaaucgagcaccagaucgggaacgugauuaauuggaccaaggauucuaucacagacauuuggacguaccaagcggaacuucugguugccauggagaaccagcacaccaucgacauggcugauagcgagaugcucaaucuguaugaacgggugagaaaacagcugcgccagaacgccgaggaagacggaaagggcuguuuugagauuuaccaugccugcgaugacuccuguauggaaagcauccggaacaauacauaugaucacucucaauacagagaggaggcucuccugaaccgccuuaauauuaaccccgucaagcuguccagcggguauaaagacaucauccucugguucucuuucggcgccuccugcuuugugcugcuugcgguugugaugggacuggucuucuuuugccucaagaauggcaacaugcgguguaccauuugcaucuga

SEQ ID NO: 193355 - RNA, 1686 nt, Artificial Sequence
  derived and/or modified sequence opt5 from hemagglutinin__InfluenzaA__AGQ81198
auguacaagaucguggucauuaucgcccugcucggcgcuguuaaagggcuggacaagauuugccuuggacaccaugccguggcgaacggcaccaucgugaaaacacugacgaaugagcaggaagaggucaccaacgcuacagaaaccguggagagcacaucccucaauagacuguguaugaaggggcggaaccacaaagaucuuggaaauugccaucccauuggcaugcugaucgggaccccugccugugaccuccaccugacaggaaccugggauacgcugaucgaacgcgagaacgccauugcuuauugcuacccgggcgccaccaucaaugaggaagcucucagacaaaagauuauggagucuggcgggaucagcaagauuuccacaggauucaccuauggcucuagcaucaacuccgccgggaauacaaaagcguguaugcggaacggaggcaauucuuuuuacgccgaacugcgcuggcuuguuagcaagaacaaagggcagaauuucccccagaccacgaacacauauagaaauaccgacacagcugagcaucugauuaucuggggaauccaccacccuuccagcaccaaggagaaaaacgaucucuacggcacccagucucuguccauuagcguggggucuuccacauaucaaaacaauuuuguccccgugguuggcgcccggccucaggugaacggacagagcggccgcaucgacuuccauuggacgcuuguccagcccggggauaauauuaccuuuucucacaacggaggccugaucgcuccuuccagagugagcaagcucauugggcggggacugggcauccaauccgacgccccgaucgauaauaacugcgaaucuaaguguuucuggcgcggcgggagcauuaauacaagacugcccuuucagaaccucuccccucggaccgugggacagugccccaaauacgucaauaagaaaagccugaugcuugcgacaggcaugcgcaacguuccugagaucaugcaggggagaggacuguucggcgccauugcuggguuuaucgaaaauggcugggagggaaugguggacggcugguacggguuccggcaucaaaacgcccagggaaccggccaggcugccgauuauaagucuacgcaagccgcuauugaccagaucacagggaaacucaaucgccugaucgaaaagaccaacaccgaguuugaguccauugaaagcgaguucucugaaaucgagcaccagauuggaaaugugaucaacuggacaaaagauagcauuaccgacaucuggacauaccaggcggaacuucuggucgccauggagaaccaacacacgauugacauggcugauuccgagaugcucaaucuguaugaaagagugcggaagcagcugagacagaacgccgaggaagacggcaagggguguuuugagaucuaccaugccugcgaugacucuuguauggaaagcauccgcaauaacaccuaugaucacucccaguaccgggaggaggcucuccugaauagacuuaacauuaaucccguuacacugagcucuggcuauaaagacaucauucucugguucuccuucggagccagcugcuuugugcugcuugcggucgugaugggccugguuuucuuuugccucaagaacgggaauaugcgcuguaccaucugcauuuga

SEQ ID NO: 193356 - RNA, 1686 nt, Artificial Sequence
  derived and/or modified sequence opt5 from hemagglutinin__InfluenzaA__AGQ81199
auguacaagaucguggucauuaucgcccugcucggcgcuguuaaagggcuggacaagauuugccuuggacaccaugccguggcgaacggcaccaucgugaaaacacugacgaaugagcaggaagaggucaccaacgcuacagaaaccguggagagcgccucccucaauagacuguguaugaaggggcggucucacaaagaucuuggaaacugccaucccauuggcaugcugaucgggaccccugccugugaccuccaccugacaggaacaugggauacccugaucgaacgcgagaaugcuauugccuauugcuacccgggcgcuacgguuaacgaggaagcccucagacaaaagaucauggagagcggcgggauuuccaagaucucuaccggauucacauauggcagcuccauuaauucugcggggaccacaaaagccuguaugcggaacggaggcaauagcuuuuacgcugaacugaaguggcuuguguccaaaagcaaggggcagaacuucccccagaccacgaauacauaucgcaacaccgacacagccgagcaucugaucauguggggcauucaccacccuucuuccacccaggagaaaaaugaucucuacggaacccaaagccugucuaucuccgucggcagcucuacauaucagaacaauuuugugcccguugugggggcuagaccucaggucaacggacaguccggccggaucgacuuccauuggacgcuugugcaacccggggauaacauuaccuuuagccacaauggaggccugaucgccccuucccgcgugucuaagcucgucgggagaggacugggcauucagagcgacgcgccgaucgauaacaauugcgaauccaaguguuucuggcggggcgggagcauuaacacacgccugcccuuucagaaucucucuccuagaaccguuggacagugccccaaauacgugaacaagcggucccugaugcuugccacaggcaugcgcaaugugccugagaucaugcaagggagaggacuguucggcgcuaucgccggguuuauugaaaacggcugggagggaauggucgacggcugguacggguuccggcaucagaaugcucagggaaccggccaagccgccgauuauaaaagcacgcagacagcuaucgaccagauuaccgggaagcucaaccgccugaucgagaaaaccaauacagaauuugagucuauugaaagcgaguucuccgaaaucgagcaccagaucggaaacgugauuaauuggaccaaggauucuaucacagacauuuggacguaccaagcggaacuucugguugccauggagaaccagcacaccaucgacauggcugauagcgagaugcucaaucuguaugaaagagugcggaaacagcugagacagaacgccgaggaagacggcaagggguguuuugagauuuaccaugccugcgaugacuccuguauggaaagcauccgcaacaauacauaugaucacucucaauaccgggaggaggcucuccugaacagacuuaauauuaaccccgucaagcuguccagcggcuauaaagacaucauccucugguucucuuucggagccuccugcuuugugcugcuugcgguugugaugggccuggucuucuuuugccucaagaaugggaacaugcgcuguaccauuugcaucuga

SEQ ID NO: 193357 - RNA, 1698 nt, Artificial Sequence
  derived and/or modified sequence opt5 from hemagglutinin__InfluenzaA__AGQ81200
augaagaaaacccugcucuuugccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucggccucggggauugcagcuuugcgggauggauccugggcaauccuaugugugacgaucuuauugggaaaaccuccuggucuuacaucguggaaaagccgaaccccgcuaauggaauuugcuauccuggcacacuggagaacgaggaagaacucagacugaaguucagcggcguucuggaauuuuccaaauucgaggccuuuaccagcacgggguggggagccgucaauucuggcgcuggggugaccgccgcuuguaaguucggauccagcaacucuuucuuccggaauaugguguggcucauccaucaauccggcacauaccccguuauuaaacgcaccuuuaacaauacaaaggggagagacgugcuggucguguggggaauccaccauccugccacccuuaaagagcaccaggaucuguauaagaaggacagcucuuacguggcggucggcuccgaaacguauaaccggcgcuucauucccgagaucagcacaagaccuaaaguuaauggccaggccgggcggaugaccuuuuacuggacaaucgugaagccgggagaauccauuaccuucgagucuaacggcgcuuuccucgcuccccgcuacgccuuugaaaucgugagcgucgggaacggaaaacuguucagauccgagcuuaauauugagagcugcucuaccaagugucagacagaaaucggcgggauuaacacgaauaaauccuuucauagcgugcaccggaacaccaucggagauugcccuaaguauguuaaugugaaaucucugaagcucgccacaggccugcgcaacguccccgcgaucgccagcagaggccuguucggggcuauugccggauuuaucgagggcggguggccuggacucauuaauggcugguacggguuccaacaccggaacgaagagggcaccggaaucgcugccgacaaggaauccacacagaaagccauugaucagaucaccucuaaggugaauaacaucguugacaaaaugaauacgaacuuugagagcgugcagcaugaguucuccgaaauugaggaacgcaucaaucaacugagcaagcacgucgaugacucuguggucgacauuugguccuauaacgcucagcuucuggugcuccuggagaaugagaaaacacuugaucugcaugacagcaacguuagaaaccuccacgagaaggugcggcgcaugcugaaggauaaugcgaaagacgagggcaacggguguuuuaccuucuaccacaagugcgauaaugaauguaucgagagaguccggaacggaaccuaugaccauaaagaauuugaggaggaaucuaagauuaauagacaggagaucgaaggcgugaaacuggauuccagcgggaacguuuacaagauucucuccaucuauucuugcaucgccagcucccuggugcuugcugcccugauuaugggauucauccucugggccugcucuaauggcagcugucgcugcacaauuuguaucuga

SEQ ID NO: 193358 - RNA, 1698 nt, Artificial Sequence
  derived and/or modified sequence opt5 from hemagglutinin__InfluenzaA__AGQ81202
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcguucuggaauuuagcaaauucgaggccuuuaccucuaauggcuggggagccgugaacuccggggcuggcgucacggccgcuuguaaguucgggagcucuaauuccuuuuuccggaacaccguguggcucauccaucaaagcggaacauaccccguuauuaaacgcaccuuuaauaacacaaagggcagagacgugcuggucguguggggagugcaccauccugccacccuuaaagagcaccaggaucuguauaagaaggacucuuccuacgucgcgguugggagcgaaacguauaaucggcgcuucauccccgagauuuccacaagaccuaaagugaacggccaggccggccggaugaccuuuuacuggacaaucgugaagccgggggaaucuaucaccuucgagagcaacggagcuuuccucgcuccccgcuacgccuuugaaauugucuccgugggcaaugggaaacuguucagaagcgagcuuaacaucgagucuugcuccaccaagugucagacagaaauuggaggcaucaauacgaacaagagcuuucauucuguucaccggaauaccauuggggauugcccuaaauaugugaacgucaaaagccugaagcucgccacaggacugcgcaaugugcccgcgaucgccuccagaggccuguucggcgcuaucgccggguuuauugagggaggcuggccugggcucaucaacggaugguacggcuuccaacaccggaaugaagaggggaccggcauugcugccgacaaggaaucuacacagaaagccaucgaucagauuaccagcaagguuaacaauaucguggaccgcaugaacacgaauuuugaguccguccagcaugagagcucugaaaucgaggaaagaauuaaccaacuguccaaacacguggaugacagcauggucgacaucuggucuuauaaugcucagcuucuggugcuccuggagaacgaaaagacacuugaucugcaugacuccaacguucggaaucuccacgagaaagugcgcagaaugcugaaggauaacgcgaaggacgagggaaauggcuguuucaccuuuuaccacaaaugcgauaacaaguguauugaacgggucagaaaugggaccuaugaccauaaagaguucgaagaggagagcaagaucaaccgccaggaaauugagggagugaaacuggauuccucuggcaauguuuacaagauccucagcauuuauuccugcaucgccucuagccuggugcuugcugcccugaucaugggguuuauucucugggccugcuccaacggaagcugucggugcacaaucuguauuuga

SEQ ID NO: 193359 - RNA, 1698 nt, Artificial Sequence
  derived and/or modified sequence opt5 from hemagglutinin__InfluenzaA__AGQ81203
augaagaaaacccugcucuuugccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcguucuggaauuuaauaaauucgaggccuuuaccagcaacggcuggggagccgucaauucuggggcuggcgugacggccgcuuguaaguucggguccagcaacucuuucuuccggaauaugguguggcucauccaucaauccggaaccuaccccguuauuaaacgcacauuuaacaauaccaagggcagagacgugcuggucgugugggggauccaccauccugccacacuuaaagagcaccaggaucuguauaagaaggacagcucuuacguggcggucggauccgaaaccuauaaccggcgcuucauucccgagaucagcacgagaccuaaaguuaacggccaggccggccggaugacauuuuacuggaccaucgugaagccgggggaauccauuacauucgagucuaauggagcuuuccucgcuccccgcuacgccuuugaaaucgugagcgucggcaacgggaaacuguucagauccgagcuuaauauugagagcugcucuaccaagugucagaccgaaaucggaggcauuaacacaaauaaauccuuucauagcgugcaccggaacacgaucggggauugcccuaaguauguuaaugugaaaucucugaagcucgccaccggacugcgcaacguccccgcgaucgccagcagaggccuguucggcgcuauugccggguuuaucgagggaggcuggccugggcucauuaauggaugguacggcuuccaacaccggaacgaagaggggacaggcaucgcugccgacaaggaauccacccagaaagccauugaucagaucacaucuaaggugaauaacaucguugaccgcaugaauaccaacuuugagagcgugcagcaugaguucuccgaaauugaggaaagaaucaaucaacugagcaaacacgucgaugacucuguggucgacauuugguccuauaacgcucagcuucuggugcuccuggagaacgaaaagacgcuugaucugcaugacagcaauguucggaaccuccacgagaaagugcgcagaaugcugaaggauaaugcgaaggacgagggaaacggcuguuuuacauucuaccacaaaugcgauaaugaauguaucgagcgggucagaaacgggaccuaugaccauaaggaauuugaggaggaaucuaaaauuaaucgccaggagaucgaaggagugaagcuggauuccagcggcaacguuuacaaaauucucuccaucuauucuugcaucgccagcucccuggugcuugcugcccugauuaugggguucauccucugggccugcucuaauggaagcugucggugcaccauuuguaucuga

SEQ ID NO: 193360 - RNA, 1698 nt, Artificial Sequence
  derived and/or modified sequence opt5 from hemagglutinin__InfluenzaA__AGQ81204
augaagaaaacccugcucuuugccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcguucuggaauuuaauaaauucgaggccuuuaccagcaacggcuggggagccgucaauucuggggcuggcgugacggccgcuuguaaguucggguccagcaacucuuucuuccggaauaugguguggcucauccaucaauccggaaccuaccccguuauuaaacgcacauuuaacaauaccaagggcagagacgugcuggucgugugggggauccaccauccugccacacuuaaagagcaccaggaucuguauaagaaggacagcucuuacguggcggucggauccgaaaccuauaaccggcgcuucauucccgagaucagcacgagaccuaaaguuaacggccaggccggccggaugacauuuuacuggaccaucgugaagccgggggaauccauuacauucgagucuaauggagcuuuccucgcuccccgcuacgccuuugaaaucgugagcgucggcaacgggaaacuguucagauccgagcuuaauauugagagcugcucuaccaagugucagaccgaaaucggaggcauuaacacaaauaaauccuuucauagcgugcaccggaacacgaucggggauugcccuaaguauguuaaugugaaaucucugaagcucgccaccggacugcgcaacguccccgcgaucgccagcagaggccuguucggcgcuauugccggguuuaucgagggaggcuggccugggcucauuaauggaugguacggcuuccaacaccggaacgaagaggggacaggcaucgcugccgacaaggaauccacccagaaagccauugaucagaucacaucuaaggugaauaacaucguugaccgcaugaauaccaacuuuggaagcgugcagcaugaguucuccgagauugaagagagaaucaaucaacugagcaaacacgucgaugacucuguggucgacauuugguccuauaacgcucagcuucuggugcuccuggaaaacgagaagacgcuugaucugcaugacagcaauguucggaaccuccacgaaaaagugcgcagaaugcugaaggauaaugcgaaggacgagggcaacggguguuuuacauucuaccacaaaugcgauaaugaguguaucgaacgggucagaaacggaaccuaugaccauaaggaguuugaagaggagucuaaaauuaaucgccaggaaaucgagggcgugaagcuggauuccagcgggaacguuuacaaaauucucuccaucuauucuugcaucgccagcucccuggugcuugcugcccugauuaugggauucauccucugggccugcucuaauggcagcugucggugcaccauuuguaucuga

SEQ ID NO: 193361 - RNA, 1698 nt, Artificial Sequence
  derived and/or modified sequence opt5 from hemagglutinin__InfluenzaA__AGQ81205
augaagaaaacccugcucuuugccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcguucuggaauuuaauaaauucgaggccuuuaccagcaacggcuggggagccgucaauucuggggcuggcgugacggccaccuguaaguucggguccagcaacucuuucuuccggaauaugguguggcucauccaucaauccggaacauaccccguuauuaaacgcaccuuuaacaauacaaagggcagagacgugcuggucgugugggggauccaccauccugcuacccuuaaagagcaccaggaucuguauaagaaggacagcucuuacguggccgucggauccgaaacguauaaccggcgcuucauucccgagaucagcacaagaccuaaaguuaacggccaggcgggccggaugaccuuuuacuggacaaucgugaagccgggggaauccauuaccuucgagucuaauggagccuuccucgcuccccgcuacgccuuugaaaucgugagcgucggcaacgggaaacuguucagauccgagcuuaauauugagagcugcucuaccaagugucagacagaaaucggaggcauuaacacgaauaaauccuuucauagcgugcaccggaacaccaucggggauugcccuaaguauguuaaugugaaaucucugaagcucgcuacaggacugcgcaacguccccgccaucgcgagcagaggccuguucggcgccauugcuggguuuaucgagggaggcuggccugggcucauuaauggaugguacggcuuccaacaccggaacgaagaggggaccggcaucgccgcugacaaggaauccacacagaaagccauugaucagaucaccucuaaggugaauaacaucguugaccgcaugaauacgaacuuugagagcgugcaguaugaguucuccgaaauugaggaaagaaucaaucaacugagcaaacaugucgaugacucuguggucgacauuugguccuacaacgcccagcuucuggugcuccuggagaacgaaaagacacuugaucugcacgacagcaauguucggaaccuccaugagaaagugcgcagaaugcugaaggauaaugcuaaggacgagggaaacggcuguuuuaccuucuaucacaaaugcgauaaugaauguaucgagcgggucagaaacgggaccuacgaccacaaggaauuugaggaggaaucuaaaauuaaucgccaggagaucgaaggagugaagcuggauuccagcggcaacguuuauaaaauucucuccaucuacucuugcaucgcgagcucccuggugcuugccgcucugauuaugggguucauccucugggccugcucuaauggaagcugucggugcacaauuuguaucuga

SEQ ID NO: 193362 - RNA, 1698 nt, Artificial Sequence
  derived and/or modified sequence opt5 from hemagglutinin__InfluenzaA__AGQ81206
augaagaaaacccuccuguucgccgcuaucuuucuguacgccaaggcggacgagauuugcaucggcuaucuuagcaacaauuccacagauaaaguggacacgauuaucgaaaacaaugucaccguuacaucuagcguggagcugguggaaaccgagcacacaggguccuucuguucuauuaacggaaagcagcccaucagccucggcgauugcuccuuugcuggguggauccugggaaauccuaugugugacgaucuuauuggcaaaaccucuuggagcuacaucgucgaaaagccgaaccccgccaaugggauuugcuauccuggaacacuggagaacgaggaagaacucagauccaaguucagcggcgugcuggaauuuucuaaauucgaggccuuuaccuccaauggcuggggagcuguuaacagcggggccggcgugacggcugccuguaaguucgggucuuccaauagcuuuuuccggaacauggucuggcugauccaucaaucuggaaccuaccccgugauuaaacgcacauuuaauaacaccaagggcagagacguucucguggucugggggauccaccauccugcgacacugaaagagcaccaggaucuuuauaagaaggacuccagcuacguggccgugggauccgaaaccuauaaucggcgcuucauucccgagaucucuacgagaccuaaagucaacggccaggcuggccggaugacauuuuacuggaccaucguuaagccggaagagagcauuacauucgaauccaacggggccuuccuggcuccccgcuacgccuuugagaucgugagcgugggaaauggcaaacucuucagaucugagcugaacauugaauccugcagcaccaagugucagaccgagaucgggggaauuaauacaaacaaaucuuuucauagcguccaccggaauacgaucggcgauugcccuaaguaugugaacguuaaaucccuuaagcuggcgaccgggcuccgcaaugugcccgccaucgcuucuagaggacuguucggcgccauugcuggcuuuaucgaagggggauggccuggccugauuaacgggugguacggauuccaacaccggaaugaggaaggcacagggaucgccgccgacaaggagagcacccagaaagcuauugaucagaucacauccaaggucaacaauaucguggaccgcaugaacaccaauuuugagagcguucagcaugaguucucugagauugaagagagaaucaaccaacucuccaaacacguggaugacagcgucguggacauuuggucuuauaaugcgcagcugcuuguccugcucgaaaacgagaagacgcuggaucuucaugacuccaacgugcggaaucugcacgagaaaguucgcagaaugcucaaggauaacgccaaggacgaaggcaauggauguuuuacauucuaccacaaaugcgauaacgaguguaucgaacgggugagaaauggcaccuaugaccauaaggaguuugaggaagagagcaaaauuaaccgccaggaaaucgagggggucaagcuggauuccucuggaaauguguacaaaauucugagcaucuauuccugcaucgcuucuagccucauucuggccgcccuuaucaugggcuucauucugugggcuugcuccaacgggagcugucggugcaccaucuguauuuga

SEQ ID NO: 193363 - RNA, 1698 nt, Artificial Sequence
  derived and/or modified sequence opt5 from hemagglutinin__InfluenzaA__AGQ81209
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcauccuggaauuuagcaaauucgaggccuuuaccucuaauggcuggggagccguuaacuccggggcuggcgugacggccgcuuguaaguucgggagcucuaauuccuuuuuccggaacauggucuggcucauucaucaaagcggaaccuaccccgugaucaaacgcacauuuaauaacaccaagggcagagacguucugauugugugggggauccaccauccugccacacuuaaagagcaccaggaucuguauaagaaggacucuuccuacgucgcggugggaagcgaaaccuauaaucggcgcuucauccccgagauuuccacgagaccuaaagugaacggccaggccggccggaugacauuuuacuggaccaucgucaagccgggggaaucuauuacauucgagagcaacggagcuuuccucgcuccccgcuacgccuuugaaaucguuuccgugggcaaugggaaacuguucagaagcgagcuuaacauugagucuugcuccaccaagugucagaccgaaaucggaggcaucaauacaaacaagagcuuucauucugugcaccggaauacgauuggggauugcccuaaauaugucaacgugaaaagccugaagcucgccaccggacugcgcaauguucccgcgaucgccuccagaggccuguucggcgcuauugccggguuuaucgagggaggcuggccugggcucauuaacggaugguacggcuuccaacaccggaaugaagaggggacaggcaucgcugccgacaaggaaucuacccagaaagccaucgaucagauuacaagcaaggugaacaauaucgucgaccgcaugaacaccaauuuugaguccgugcagcaugaguucagcgaaauugaggaaagaaucaaccaacugucuaaacacguugaugacuccguggucgacauuuggagcuauaaugcucagcuucuggugcuccuggagaacgaaaagacgcuugaucugcaugacucuaacguccggaaucuccacgagaaagugcgcagaaugcugaaggauaacgcgaaggacgagggaaauggcuguuuuacauucuaccacaaaugcgauaacgaauguaucgagcggguuagaaaugggaccuaugaccauaaggaauuugaggaggaauccaaaauuaaccgccaggagaucgaaggagugaagcuggauagcuccggcaaugucuaccggauccucucuauuuauagcugcaucgccuccucucuggugcuugcugcccugauuaugggguucauccucugggccugcagcaacggauccuguagaugcaccauuuguaucuga

SEQ ID NO: 193364 - RNA, 1698 nt, Artificial Sequence
  derived and/or modified sequence opt5 from hemagglutinin__InfluenzaA__AGQ81211
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaagaacucagacugaaguucuccggcguucuggaauuuagcaaauucgaggccuuuaccucuaauggcuggggagccgugaacuccggggcuggcgucacggccgcuuguaaguucgggagcucuaauuccuuuuuccggaacaugguguggcucauccaucaaagcggaaccuaccccguuauuaaacgcacauuuaauaacaccaagggcagagacgugcugaucgucugggggauucaccauccugccacacuuaaagagcaccaggaucuguauaagaaggacucuuccuacguggcggugggaagcgaaaccuauaaucggcgcuucauccccgagaucuccacgagaccuaaagucaacggccaggccggccggaugacauuuuacuggaccauuguuaagccgggggaaucuaucacauucgagagcaacggagcuuuccucgcuccccgcuacgccuuugaaauuguguccgugggcaaugggaaacuguucagaagcgagcuuaacaucgagucuugcuccaccaagugucagaccgaaauuggaggcaucaauacaaacaagagcuuucauucuguccaccggaauacgaucggggauugcccuaaauaugugaacguuaaaagccugaagcucgccaccggacugcgcaaugugcccgcgauugccuccagaggccuguucggcgcuaucgccggguuuauugagggaggcuggccugggcucaucaacggaugguacggcuuccaacaccggaaugaagaggggacaggcauugcugccgacaaggaaucuacccagaaagccaucgaucagaucacaagcaaggucaacaauauuguggaccgcaugaacaccaauuuugaguccguucagcaugaguucagcgaaaucgaggaaagaauuaaccaacugucuaaacacguggaugacuccgucguggacaucuggagcuauaaugcucagcuucugguccuccuggagaacgaaaagacgcuugaucugcaugacuuuaacgugcggaaucuccacgagaaaguucgcagaaugcugaaggauaacgcgaaggacgagggaaauggcuguuucacauuuuaccacaaaugcgauaacgaauguauugagcgggugagaaaugggaccuaugaccauaaggaguucgaggaggaaucuaaaaucaaccgccaggagauugaaggagucaagcuggauuccagcggcaauguguaccggauccucuccaucuauucuugcauugccagcucccugguucuugcugcccugaucaugggguuuauucucugggccugcucuaacggaagcuguagaugcaccaucuguauuuga

SEQ ID NO: 193365 - RNA, 1698 nt, Artificial Sequence
  derived and/or modified sequence opt5 from hemagglutinin__InfluenzaA__AGQ81213
augaagaaaacccuccuguucgccgcuaucuuucuguacgugagagccgacgagauuugcaucggcuaucuuagcaacaauuccacagauaaggucgacacgauuaucgaaaacaauguuaccgugacaucuagcguggagcuggucgaaaccgagcacacaggguccuucuguucuauuaacggaaaacagcccaucagccucggcgauugcuccuuugcgggguggauccugggaaauccuaugugugacggccuuauugggaagaccucuuggagcuacaucguggaaaaaccgaaccccgcuaauggaauuugcuauccuggcacacuggagaacgaggaggaacuccggcugaaguucucccgcguucuggaauuuagcaaguucgaggccuuuaccucuaauggcuggggagccgugaacuccggggcuggcgucacggccgcuuguaaauucgggagcucuaauuccuuuuucagaaacaugguguggcucauccaucaaagcggaaccuaccccguuauuaagcggacauuuaauaacaccaaaggccgcgaugugcuggucgugugggggauccaccauccugccacacuuaaggagcaccaggaccuguauaaaaaggauucuuccuacguggcggucggaagcgaaaccuauaauagacgguucauucccgagaucuccacgcgcccuacaguuaacggccaggccggcagaaugaccuuuuacuggacaaucgugaagccgggggaaucuauuaccuucgagagcaacggagcuuuccucgcuccccgguacgccuuugaaaucguguccgucggcaaugggaaacuguuccgcagcgagcuuaacauugagucuugcuccaccaagugucagacagaaaucggaggcauuaauacgaacaagagcuuucauucugugcacagaaauaccaucggggacugcccuaaauauguuaacgugaaaagccugaagcucgccacaggacugcggaauguccccgcgaucgccucccgcggccuguucggcgcuauugccggguuuaucgagggaggcuggccugggcucauuaacggaugguacggcuuccaacacagaaaugaagaggggaccggcaucgcugccgauaaagaaucuacacagaaggccauugaccagaucaccagcaaggugaacaauaucguugaucggaugaacacgaauuuugaguccgugcagcaugaguucagcgaaauugaggaacgcaucaaccaacugucuaaacacgucgacgauuccguggucgacauuuggagcuauaaugcucagcuucuggugcuccuggagaacgaaaagacacuugaccugcaugauucuaacguuagaaaucuccacgagaaagugcggagaaugcugaaggacaacgcgaaagaugagggaaauggcuguuuuaccuucuaccacaagugcgacaacgaauguaucgagcgcguccggaaugggaccuaugaucauaaggaauuugaggaggaauccaaaauuaacagacaggagaucgaaggagugaagcuggacagcuccggcaauguuuacaaaauucucucuaucuauagcugcaucgccuccucucuggugcuugcugcccugauuaugggguucauccucugggccugcagcaacggauccugucgcugcacaauuuguaucuga

SEQ ID NO: 193366 - RNA, 1698 nt, Artificial Sequence
  derived and/or modified sequence opt5 from hemagglutinin__InfluenzaA__AGQ81214
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaggaacucagacugaaguucuccggcguucuggaauuuagcaaauucgaggccuuuaccucuaauggcuggggagccgugaacuccggggcuggcgucacggccgcuuguaaguucgggagcucuaauuccuuuuuccggaacaugguguggcucauccaucaaagcggaaccuaccccguuauuaaacgcacauuuaauaacaccaagggcagagacgugcugaucgucugggggauucaccauccugccacacuuaaagagcaccaggaucuguauaagaaggacucuuccuacguggcggugggaagcgaaaccuauaaucggcgcuucauccccgagaucuccacgagaccuaaagucaacggccaggccggccggaugacauuuuacuggaccauuguuaagccgggggaaucuaucacauucgagagcaacggagcuuuccucgcuccccgcuacgccuuugaaauuguguccgugggcaaugggaaacuguucagaagcgagcuuaacaucgagucuugcuccaccaagugucagaccgaaauuggaggcaucaauacaaacaagagcuuucauucuguccaccggaauacgaucggggauugcccuaaauaugugaacguuaaaagccugaagcucgccaccggacugcgcaaugugcccgcgauuacauccagaggccuguucggcgccaucgcuggguuuauugagggaggcuggccugggcucaucaacggaugguacggcuuccaacaccggaaugaagaggggaccggcauugccgcugacaaggaaucuacacagaaagccaucgaucagaucaccagcaaggucaacaauauuguggaccgcaugaacacgaauuuugaguccguucagcaugaguucagcgaaaucgagggaagaauuaaccaacugucuaaacacguggaugacuccgucguggacaucuggagcuauaaugcccagcuucugguccuccuggaaaacgagaagacacuugaucugcaugacucuaacgugcggaaucuccacgaaaaaguucgcagaaugcugaaggauaacgcuaaggacgagggcaauggguguuuuaccuucuaccacaaaugcgauaacgaguguauugaacgggugagaaauggaaccuaugaccauaaggaguuugaagaggaguccaaaaucaaccgccaggaaauugagggcgucaagcuggauagcuccgggaauguguacaaaauccucucuaucuauagcugcauugcguccucucugguucuugccgcucugaucaugggauucauucucugggccugcagcaacggcuccugucggugcacaaucuguauuuga

SEQ ID NO: 193367 - RNA, 1698 nt, Artificial Sequence
  derived and/or modified sequence opt5 from hemagglutinin__InfluenzaA__AGQ81215
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacggccuuauugggaaaaccucuuggagcuacaucguggaaaagccgaaccccgcuaauggaauuugcuauccuggcacacuggagaacgaggaggaacucagacugaaguucuccggcauccuggaauuuagcaaauucgaggccuuuaccucuaauggguggggagccguuaacuccggcgcuggggugacggccgcuuguaaguucggaagcucuaauuccuuuuuccggcauauggucuggcucauucaccaaagcggcaccuaccccgugaucaaacgcacauuuaacaauaccaaggggagagauguucugguggucuggggcauucaucacccugccacacuuaaagagcagcaggaccuguauaagaaggauucuuccuacguggcggugggaagcgaaaccuauaaccggcgcuucauccccgagaucuccacgagaccuaaagucaauggccaggccgggcggaugacauuuuacuggaccauuguuaagccgggagaaucuaucacauucgagagcaacggcgcuuuccucgcuccccgcuacgccuuugaaauuguguccguggggaacggaaaacuguucagaagcgagcuuaauaucgagucuugcuccaccaagugucaaaccgaaauuggcgggaucaacacaaauaagagcuuucauucuguccaccggaacacgaucggagacugcccuaaauaugugaauguuaaaagccugaagcucgccaccggccugcgcaacgugcccgcgauugccuccagaggccuguucggggcuaucgccggauuuauugagggcggguggccuggacucaucaauggcugguacggguuccagcaccggaacgaagagggcacaggaauugcugccgauaaggaaucuacccagaaagccaucgaccagaucacaagcaaggucaauaacauuguggaucgcaugaauaccaacuuugaguccguucaacaugaguucagcgaaaucgaggaaagaauuaaucagcugucuaaacacguggacgauuccgucguggacaucuggagcuauaacgcucagcuucugguccuccuggagaaugaaaagacgcuugaccugcaugauucuaacgugcggaaccuccacgagaaaguucgcagaaugcugaaggacaaugcgaaggaugagggcaacggguguuuuacauucuaccacaaaugcgacaaugaauguauugagcgggugagaaacggaaccuaugaucauaaggaauuugaggaggaauccaaaaucaaucgccaggagauugaaggcgucaagcuggacagcuccgggaacguguacaaaauccucucuaucuauagcugcauugccuccucucugguucuugcugcccugaucaugggauucauucucugggccugcagcaauggcuccugucggugcaccaucuguauuuga

SEQ ID NO: 193368 - RNA, 1698 nt, Artificial Sequence
  derived and/or modified sequence opt5 from hemagglutinin__InfluenzaA__AGQ81216
augaagaaaacccuccuguucgccgcuaucuuucuguacgugaaggccgacgagauuugcaucggcuaucuuagcaacaauuccacagauaaagucgacacgauuaucgaaaacaauguuaccgugacaucuagcguggagcuggucgaaaccgagcacacaggguccuucuguucuauuaacggaaagcagcccaucagccucggcgauugcuccuuugcgggguggauccugggaaauccuaugugugacgaucuuauuggcaaaaccucuuggagcuacaucguggaaaagccgaaccccgcuaaugggauuugcuauccuggaacacuggagaacgaggaagaacucagacugaaguucuccggcguucuggaauuuagcaaauucgaggccuuuaccucuaauggcuggggagccgugaacuccggggcuggcgucacggccgcuuguaaguucgggagcucuaauuccuuuuuccggaacaugguguggcucauccaucaaagcggaaccuaccccguuacaaaacgcaccuuuaauaacacaaagggcagagacgugcuggucgugugggggauucaccauccugccacccuuaaagagcaccaggaucuguauaagaaggacucuuccuacguggcggucggaagcgaaacguauaaucggcgcuucacacccgagaucuccaccagaccuaaaguuaacggccaggccggccggaugacauuuuacuggaccauugugaagccgggggaaucuaucaccuucgagagcaacggagcuuuccucgcuccccgcuacgccuuugaaaucguguccgucggcaaugggaaacuguucagaagcgagcuuaacauugagucuugcuccacaaagugucagacggaaaucggaggcauuaauaccaacaagagcuuucauucugugcaccggaauacaaucggggauugcccuaaauauguuaacgugaaaagccugaagcucgccaccggacugcgcaauguccccgcgauugccuccaagggccuguucggcgcuaucgccggguuuaucgagggaggcuggccugggcucauuaacggaugguacggcuuccaacacagaaaugaagaggggacaggcaucgcugccgacaaagaaucuacccagaaggccauugaucagaucacgagcaaagugaacaauauuguugaccggaugaacacaaauuuugaguccgugcgccaugaguucagcgaaaucgaggaaagaaucaaccagcugucuaagcacgucgaugacuccguggucgacauuuggagcuauaaugcucaacuucuggugcuccuggagaacgagaaaacccuugaucugcaugacucuaacguucggaaucuccacgagcgcgugagacggaugcugaaggauaacgcgaaggacgagggaaauggcuguuuuaccuucuaccacaaaugcgauaacgaauguaucgagagaguccgcaaugggacauaugaccauaaggaauuugaggaggaauccaaaauuaaccggcaggagaucgaaggagugaagcuggauagcuccggcaauguuuacaaaauucucucuaucuauagcugcauugccuccucucuggugcuugcugcccugaucaugggguucauccucugggccugcggaaacggcagcuguagaugcaccauuuguaucuga

SEQ ID NO: 193369 - RNA, 1698 nt, Artificial Sequence
  derived and/or modified sequence opt5 from hemagglutinin__InfluenzaA__AGQ81217
augaagaaaacccuccuguucgccgcuaucuuucuguacgccaaggcggacgagauuugcaucggcuaucuuagcaacaauuccacagauaaaguggacacgauuaucgaaaacaaugucaccguuacaucuagcguggagcugguggaaaccgagcacacaggguccuucuguucuauuaacggaaagcagcccaucagccucggcgauugcuccuuugcuggguggauccugggaaauccuaugugugacgaucuuauuggcaaaaccucuuggagcuacaucgucgaaaagccgaaccccgccaaugggauuugcuauccuggaacacuggagaacgaggaagaacucagacugaaguucuccggcgugcuggaauuuagccgguucgaggccuuuaccucuaauggcuggggagcuguuaacuccggggccggcgugacggcugccuguaaauucgggagcucuaauuccuuuuuccgcaacauggucuggcucauccaucaaagcggaaccuaccccgugauuaagagaacauuuaauaacaccaaaggccgggacguucugguggucugggggauccaccauccugcgacacuuaaggagcaccaggaucuguauaaaaaggacucuuccuacguggccgugggaagcgaaaccuauaaucgcagauucauucccgagaucuccacgcggccuaaggucaacggccaggcuggccgcaugacauuuuacuggaccaucguuaaaccggaagagucuauuacauucgaaagcaacggggccuuccucgcucccagauacgccuuugagaucguguccgugggaaauggcaagcuguuccggagcgagcuuaacauugaaucuugcuccaccaaaugucagaccgagaucgggggaauuaauacaaacaagagcuuucauucuguccaccgcaauacgaucggcgauugcccuaaauaugugaacguuaagagccugaaacucgcgaccgggcugagaaaugugcccgccaucgcuucccggggacuguucggcgccauugcuggcuuuaucgaagggggauggccuggccucauuaacgggugguacggauuccaacaccgcaaugaggaaggcacagggaucgccgccgacaaggagucuacccagaaggcuauugaucagaucacaagcaaagucaacaauaucguggacagaaugaacaccaauuuugaguccguucagcaugaguucagcgagauugaggaacggaucaaccaacugucuaagcacguggaugacuccgucguggacauuuggagcuauaaugcgcagcuucugguccuccuggaaaacgagaaaacgcuugaucugcaugacucuaacgugcgcaaucuccacgagaagguuagacggaugcugaaagauaacgccaaggacgaaggcaauggauguuuuacauucuaccacaagugcgauaacgaguguaucgaaagagugcgcaauggcaccuaugaccauaaagaguuugaggaagaguccaagauuaaccggcaggaaaucgagggggucaaacuggauagcuccggaaauguguacaagauucucucuaucuauagcugcaucgcuuccucucugauucuugccgcccugaucaugggcuucauucucugggcuugcagcaacggguccuguagaugcaccaucuguauuuga

SEQ ID NO: 193370 - RNA, 1704 nt, Artificial Sequence
  derived and/or modified sequence opt5 from hemagglutinin__InfluenzaA__AGQ88499
auggagaagaucgugcuccuguucgccaccauuagccuggucaaauccgaccacaucugcauuggcuaccaugcuaacaauucuacagaacagguugauacgaucauggagaagaacgugaccgugacacacgcccaagacauucuugaaaagacccauaaugggaagcugugugaucucaacggagucaaaccccugauccuuaaggacugcagcguggcgggcuggcugcucgggaauccuaugugugaugaguuuaucaacguuccggaaugguccuauauuguggagaaggcuaaucccgccaacgaccugugcuacccuggaaauuucaacgauuaugaggaacugaaacaccuccugucuagaaucaaucauuuugagaagauucagaucauucccaaagacagcuggacagaucacgaagccucccuuggcgucucugcugccuguccuuaccaggggaacagcuccuucuuucggaaugugguuuggcugaucaagaaagacaacgcuuaucccaccauuaagaagggauacaauaacacaaaccaggaggaucuccuggugcuuuggggcauccaccauccuaauaacgaggccgaacaaacccgccuguaucagaauccgacgaccuacaucagcauuggcacaucuacccucaaccagagacugguccccaaaaucgcgacacgguccaagauuaaugggcagagcggacgcaucgacuucuuuuggaccauucugaaaccuaacgaugccauccacuucgagucuaauggcaacuuuaucgcucccgaauacgccuauaagauugugaaaaagggggacuccacgaucaugaaaagcgagguggaauacggaaauugcaacacaagaugucaaaccccuauuggcgcuaucaauucuuccaugcccuuccauaacauucacccgcucacaaucggggagugcccuaaguaugucaagagcaauaaacugguucuugccaccggacugcggaacucuccccagcgcgagagacggcgcaagagaggccucuuuggcgcgaucgccggguucauugaaggaggcuggcaggggaugguggacggaugguacggcuaucaccauuccaaugagcaggggagcggauacgcugccgauaaagaauccacccaaaaggcuaucgacggcgugacaaacaaagucaacagcauuaucgauaagaugaauacgcaguuugaggccgugggccgggaguucaacaaucuggaacgcagaauugagaaccuuaauaagaaaauggaagacggguuccuggauguuuggaccuauaacgccgagcuccuggugcugauggaaaaugagcggacacucgacuaccacgauucuaacguccgcaaucuguacgacaaggugagacuucagcugaaagauaacgcuaaggaacucggaaauggcuguuuugaguucuaucauaaaugcaacaaugaguguauggaauccguucggaacgggaccuacgacuauccucaauacagcgaggaagcgagacugaagcgcgaggagaucucuggagugaaacuugaaagcauuggcaucuaucagauccuguccauuuacucuacagucgccagcucccucgugcuggcuaucaugauggccgggcugagccucuggaugugcucuaauggcucccugcagugccggauuuguaucuga

SEQ ID NO: 193371 - RNA, 1683 nt, Artificial Sequence; identical to SEQ ID NO: 193261
  derived and/or modified sequence opt5 from hemagglutinin__InfluenzaA__AGR33888

SEQ ID NO: 193372 - RNA, 1683 nt, Artificial Sequence; identical to SEQ ID NO: 193261
  derived and/or modified sequence opt5 from hemagglutinin__InfluenzaA__AGR33889

SEQ ID NO: 193373 - RNA, 1683 nt, Artificial Sequence
  derived and/or modified sequence opt5 from hemagglutinin__InfluenzaA__AGR33890
augaacacccagauccugguguucgcccucauugcuaucacacccacgaauagcgacaagauuugccugggccaccaugccgucuccaacgggaccaaaguuaauacacuuaccgagagaggaguggaaguggucaacgcgacagagaccguggaacggacaucuaucccucgcauuuguagcaagggcaaaagaaccguugaucuggggcaaugcggacuccugggcacgaucaccgggccgccccagugugaccaguuucuugaguucuccgcugaucugaucauugaacggcgcgagggaucugacgugugcuacccuggcaaguuugucaaugaggaagcccucagacagauccugcgggagagcggcgggauugauaaagaagccaugggauucacauauuccggcauccgcaccaacggggcuacaucugccuguagacggagcggauccagcuuuuacgcugagaugaaguggcugcucucuaauaccgacaacgccgcguuucccccuaugacgaaguccuauaaaaauacacgcaaggcccccgcucugauuaucuggggcauucaccauagcgugucuaccgccgagcaaacaaaacuuuacggguccggaaacaagcugguuaccgugagaagcucuaauuaucagcaguccuucgucccuagcccgggcgcuggcccccaggugaacgggcaauccggacggaucgauuuccacuggcucaugcugaauccuaacgacaccgugacauuuucuuucaauggcgccuuuaucgcgcccgaucgcgccagcuuccuuagagggaaauccaugggcauucagagcggaguccagguugacgcuaacugcgaaggggauuguuaccauucuggaggcacgaucauuuccaaccugccuuuucagaauaucgacagccggguggugggcaagugcccccgcuaugucaagcaaaaaucucuccugcuggccaccgggaugaagaacgugccggagauuccuaaaggaagaggccucuucggggcuaucgccggauucaucgaaaauggcugggaggggcugauugauggcugguacggauuucggcaccagaacgcccagggcgaagggacagcugcggacuacaagagcacccaauccgccaucaaucagaugacaggaaaacuuaacagacugauugagaagaccaaucagcaguucgagcucaucgacaacgaauuuacggagguugaaaaacaaauuggcaaugugaucaacuggacacgcgauucuaucaccgaggucuggagcuauaaugcugaacugcuuguggccauggagaaccagcacaccauugaccuggccgauuccgagaugaauaagcucuacgaacggguuaagagacagcugcgcgagaacgcugaagaggacgggacaggauguuucgaaaucuuucauaaaugcgaugacgauuguauggccagcauucggaauaacaccuaugaccacucuaaguacagagaggaggcgaugcagaaccgcauccaaauugaucccgugaaacuguccagcggcuauaaggacgucauccucugguucucuuuuggggcuuccugcuucauucugcuugccaucgccaugggccugguguuuaucugcgucaaaaauggaaacaugcgguguacaauuugcaucuga

SEQ ID NO: 193374 - RNA, 1683 nt, Artificial Sequence
  derived and/or modified sequence opt5 from hemagglutinin__InfluenzaA__AGR33892
augaacacccagauccugguguucgcccucauugcuaucauucccacaaaugccgacaagaucugccugggccaccaugcggucagcaacgggacgaaaguuaauacccuuacagagagaggaguggaaguggucaacgcuaccgagacaguggaacggaccuccauuccucgcaucuguucuaagggcaaaagaacaguugaucuggggcaaugcggacuccugggcaccaucacggggccgccccagugugaccaguuucuugaguucagcgccgaucugauuaucgaacggcgcgagggauccgacgugugcuacccuggcaaguuugucaaugaggaagcccucagacagauucugcgggagucuggcgggaucaacaaagaagcuaugggauucaccuauagcggcauucgcacaaauggggccaccuccgcuuguagacggucuggaagcuccuuuuacgccgagaugaaguggcugcucagcaacacagauaaugcggccuuucccccuaugaccaagucuuauaaaaacacgcgcaaggcucccgcccugaucauuuggggcauccaccauuccgggagcacagcugagcaaaccaaacuuuacggaucuggcaauaagauggugacaguuagauccagcaacuaucagcagucuuucgugccuuccccgggcgccgggccccaggucaauggacaaagcggccggaucgacuuccacuggcugaugcucaacccuaaugauaccgugaccuuuuccuucaacggggcguuuauugcccccgaccgcgcuucuuuccugagaggaaaaagcaugggcauccaguccggggugcaggucgaugccaacugcgaaggagacuguuaccauagcggcggcacaauuaucucuaaucuuccuuuucagaacauugauucccggguuguggggaagugcccccgcuaugugaagcagaaaagccugcuccuggcuacgggaaugaagaaugucccggagaucccuaaaggcagagggcuguucggagccaucgccggcuucauugaaaacgggugggagggccucaucgacggaugguacggcuuucggcaccaaaaugcucagggggaaggaaccgcggccgauuacaagucuacacaaagcgcuauuaaccagaugaccggcaaacugaauagacuuaucgagaagacaaaccagcaguucgagcugauugacaaugaauuuaccgagguggaaaaacaaaucgggaacguuaucaauuggacgcgcgacuccauuacagagguguggucuuauaacgccgaacuccuggucgccauggagaaucagcacaccaucgaucuugcugacagcgagaugaacaagcuguacgaacgggugaagagacagcuccgcgagaaugccgaagaggauggaaccggcuguuucgaaauuuuucauaaaugcgacgaugacuguauggcguccauccggaacaacacauaugaucacagcaaguacagagaggaggcuaugcagaaucgcauucaaaucgaccccguuaaacugucuuccggguauaaggaugugauucugugguucagcuuuggcgccucuugcuucauccuccuggccaucgcuaugggacuugucuuuauuugcguggaaaacggcaauaugcgguguaccaucugcauuuga

SEQ ID NO: 193375 - RNA, 1683 nt, Artificial Sequence; identical to SEQ ID NO: 193253
  derived and/or modified sequence opt5 from hemagglutinin__InfluenzaA__AGR33895

SEQ ID NO: 193376 - RNA, 1683 nt, Artificial Sequence; identical to SEQ ID NO: 193332
  derived and/or modified sequence opt5 from hemagglutinin__InfluenzaA__AGR33897

SEQ ID NO: 193377 - RNA, 1683 nt, Artificial Sequence
  derived and/or modified sequence opt5 from hemagglutinin__InfluenzaA__AGR33899
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauaacggaacauccaaggccuguagcggcucuuucuaccgcuccaugagauggcuuacccagaaaaauagcaacuauccuauccaagaugcucaguacacgaauaaccagggcaagaauauucuguuuaugugggggaucaaccaucccccuacagacaccacacagcgggaucucuacacccgcaccgacacaacgaccucuguggccacagaggaaauuaacagaaucuucaaaccgcugaucggaccccggccucugguuaauggccucauggggcgcauugauuauuacugguccgugcugaagcccggacaaacccuuagaaucaagagcgacggcaaccugauugcuccuugguaugggcacauccucuccggagagucucauggccggauucugaaaacagaucuuaagaaaggcagcugcaccguccagugucagacggaaaaagggggacugaauacaacccuccccuuucagaacguguccaaguacgccuucggcaauugcagcaaguauaucgggaucaagucucugaaacuggcggugggacuccgcaacgucccguccagaagcucucggggccuguuuggggccauugcuggauucaucgagggcggcuggagcgggcuuguugccggaugguacggcuuucaacacuccaaugaccagggggugggaauggcugccgaucgcgacucuacccagaaggcgauugacaaaaucacaagcaaggugaacaauauugucgauaaaaugaacaagcaauaugaaaucaucgaccacgaguucuccgagguggaaaccagacugaauaugauuaacaauaaaaucgaugaccagauucaggauaucugggccuacaacgcugagcuccugguucuucuggaaaaucagaagacacucgacgagcaugaugccaacgugaacaaucuguacaacaaggucaaacgggcucugggcagcaaugccguggaagacgggaagggcuguuuugagcucuaucacaaaugcgaugaccaauguauggagacgauuagaaacggaaccuacaaucgcucuaaguaucaggaagaguccaaacuggaacggcagaagaucgagggcguuaaacuugaaagcgaggggacauacaagauucugaccaucuauucuacaguggccuccagccucgucaucgcuaugggauucgcggccuuucuguucugggcuauguccaacggcucuugcagaugcaauauuuguaucuga

SEQ ID NO: 193378 - RNA, 1683 nt, Artificial Sequence
  derived and/or modified sequence opt5 from hemagglutinin__InfluenzaA__AGR33900
auggagaccgugagccugaucacaauucuccuggucgccacgguuuccaacgcugacaagaucugcauuggcuaccagucuaccaauagcacagaaaccguggauacacuuaccgagaacaaugugcccgucacacacgccaaagaacugcuccauaccgagcacaacgggaugcugugugcgacgucccuuggacaaccucugauccucgauaccugcacaauugaaggccugaucuaugggaauccgucuugugaccugcuccuggagggaagagaguggagcuacaucguggaacggcccuccgcuguuaacggccuuugcuauccugggaauguggagaaccuggaggaacuccgcucucuguucagcuccgccagaagcuaccagcggauucagaucuuucccgacaccauuuggaaugucucuuauaacggaacauccaaggccuguagcggcucuuucuaccgcuccaugagauggcuuacccagaaaaauagcgauuauccuauccaagacgcucaguacacgaacaaucagggcaagaacauucuguuuaugugggggaucaaucaucccccuacagauaccacacagcgggaccucuacacccgcaccgauacaacgaccucuguggccacagaggaaauuaacagaaucuucaaaccgcugaucggaccccggccucugguuaacggccucauggggcgcauugacuauuacugguccgugcugaagcccggacaaacccuuagaaucaagagcgauggcaaucugauugcuccuugguaugggcacauccucuccggagagucucauggccggauucugaaaacagaccuuaagaaaggcagcugcaccguccagugucagacggaaaaagggggacugaacacaacccuccccuuucagaauguguccaaguacgccuucggcaacugcagcaaguauaucgggaucaagucucugaaacuggcggugggacuccgcaaugucccguccagaagcucucggggccuguuuggggccauugcuggauucaucgagggcggcuggagcgggcuuguugccggaugguacggcuuucaacacuccaacgaucagggggugggaauggcugccgaccgcgacucuacccagaaggcgauugauaaaaucacaagcaaggugaauaacauugucgacaaaaugaauaagcaauaugaaaucaucgaucacgaguucuccgagguggaaaccagacugaacaugauuaauaacaaaaucgacgaucagauucaggacaucugggccuacaaugcugagcuccugguucuucuggaaaaccagaagacacucgaugagcaugacgccaaugugaacaaccuguacaauaaggucaaacgggcucugggcagcaacgccguggaagaugggaagggcuguuuugaccucuaucacaaaugcgaugaccaauguauggagacgauuagaaauggaaccuacaaccgccggaaguaucaggaggaaucuaaacuggagagacagaagaucgaaggcguuaaacuugaguccgaagggacauacaagauucugaccaucuauagcacaguggccucuucccucgucaucgcuaugggauucgcggccuuucuguucugggcuaugagcaauggcuccugccgcugcaacauuuguaucuga

SEQ ID NO: 193379 - RNA, 1683 nt, Artificial Sequence
  derived and/or modified sequence opt5 from hemagglutinin__InfluenzaA__AGR33902
auggagaccgccagccugaucacaauucuccugguggcuacggucuccaacgccgacaagaucugcauuggcuaccagucuaccaauagcacagaaaccguugauacacuuaccgagaacaaugugcccgugacacacgcgaaggaacugcuccauaccgagcacaacgggaugcugugugcuacgucccuuggacaaccucugauccucgauaccugcacaauugaaggccugaucuaugggaauccgucuugugaccugcuccuggagggaagagaguggagcuacaucgucgaacggcccuccgccgugaacggccuuugcuauccugggaauguugagaaccuggaggaacuccgcucucuguucagcuccgccagaagcuaccagcggauucagaucuuucccgacaccacauggaaugugucuuauaacggaauuuccaaggcuuguagcggcucuuucuaccgcuccaugagauggcuuacccagaaaaauagcaacuauccuauccaagaugcccaguacacgaauaaccagggcaagaauauucuguuuaugugggggaucaaccaucccccuacagacaccacacagcgggaucucuacacccgcaccgacacaacgaccucugucgcuacagaggaaauuaacagaaucuucaaaccgcugaucggaccccggccucuggugaauggccucauggggcgcauugauuauuacugguccguucugaagcccggacaaacccuuagaaucaagagcgacggcaaccugauugccccuugguaugggcacauccucuccggagagucucauggccggauucugaaaacagaucuuaagcgcggcagcugcaccgugcagugucagacggaaaaagggggacugaauacaacccuccccuuucagaacgucuccaaguacgcguucggcaauugcagcaaauauaucgggaucaagucucugaagcuggccgugggacucagaaacgugccgucccggagcucucgcggccuguuuggggcuauugccggauucaucgagggcggcuggagcgggcuugucgcuggaugguacggcuuucaacacuccaaugaccaggggguuggaauggccgcggauagagacucuacccagaaagccauugacaagaucacaagcaaagugaacaauauuguggauaagaugaacaaacaauaugaaaucaucgaccacgaguucuccgaggucgaaacccggcugaauaugauuaacaauaagaucgaugaccagauucaggauaucugggcuuacaacgccgagcuccuggugcuucuggaaaaucagaaaacacucgacgagcaugaugcuaacguuaacaaucuguacaacaaggugaagagagcccugggcagcaaugccgucgaagacgggaaaggcuguuuugagcucuaucacaagugcgauaaccaauguauggagacgauucgcaauggaaccuacaaccggagaaaauaucaggaagagucuaagcuggaacgccagaaaaucgagggcgugaaacuugaauccgaggggacauacaagauucugaccaucuauagcacaguugcuucuucccucgugaucgcgaugggauucgccgcuuuucuguucugggccaugagcaauggcuccugccggugcaacauuuguaucuga

SEQ ID NO: 193380 - RNA, 1698 nt, Artificial Sequence; identical to SEQ ID NO: 188537
  derived and/or modified sequence opt5 from hemagglutinin__InfluenzaA__AGR49817

SEQ ID NO: 193381 - RNA, 1698 nt, Artificial Sequence
  derived and/or modified sequence opt5 from hemagglutinin__InfluenzaA__AGR49841
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagccccgcgacacaauuaucuuugaagccaaugggaaccucauugcgccuagauacgccuucgcucugucccggggauuuggcagcgggaucauuaauucuaacgcccccaugggaaagugugaugcuaaaugccagaccccgcaaggcgccaucaauuccagccuuccuuuccagaacguccaccccgugacaaucggcgaguguccuaaguauguucgcucugcgaaacugagaauggugaccgggcuccggaauauucccagcauccagucccgcggacuguuuggcgccauugcuggguucaucgaaggaggcuggaccgggauggucgacggaugguacggcuaucaucaccagaacgagcaaggcucuggguacgccgcugaucaaaagagcacacagaaugccauuaacggaaucacgaauaaagugaacuccguuaucgaaaagaugaauacccaguuuacagccgugggcaaggaguucaacaaacuggagagacggauggaaaaccucaauaagaaagucgacgauggguucauugacaucuggaccuacaacgcugagcugcuugugcugcucgaaaaugagcgcacacuggauuuucacgacagcaacgucaagaaucuuuaugaaaaagugaagucucagcugaagaacaaugcgaaagagauuggaaacggcugcuucgaguuuuaccauaaguguaaugacgaaugcauggaguccguuaaaaacgggaccuaugauuaccccaaguauagcgaagagucuaaacucaauagagagaagaucgacggcgugaagcuggaauccauuggagucuaccagauccuggccaucuauagcacgguggcuuccucucucguucugcuugugagccugggcgccauuuccuucuggaugugcucuaacgggagccuccagugucggaucugcauuuga

SEQ ID NO: 193382 - RNA, 1698 nt, Artificial Sequence; identical to SEQ ID NO: 188537
  derived and/or modified sequence opt5 from hemagglutinin__InfluenzaA__AGR49853

SEQ ID NO: 193383 - RNA, 1698 nt, Artificial Sequence
  derived and/or modified sequence opt5 from hemagglutinin__InfluenzaA__AGR49865
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacaaucacaacgggaaacuuugccugcucaagggaaucgcgccccugcagcugggcaauuguucuguugcuggguggauucucggaaacccugagugcgaacugcuuaucagcaaagaguccuggucuuacauuguggaaaagccgaaucccgagaacggcaccuguuauccugggcauuuugccgauuacgaggaacugagagagcaacucagcuccgucucuagcuucgaacgguuugagaucuuccccaaggaguccagcuggccuaaucacacggugaccggaguuucugccuccugcagccauaacggcgaaucuuccuuuuaucgcaaucugcuuuggcugacaggcaaaaacgggcucuaccccaaucugagcaagucuuaugcuaacaacaaagagaaggaagugcugguccucuggggagugcaccacccuccgaauaucgugaaccagaaaacccuguacagaacagagaaugccuacgucuccguugugagcucccauuauucucggaaguucacccccgaaauugcuaagcgcccuaaagugagagaccaggagggccggaucaacuacuauuggacgcuucuggagcccggggauacaauuaucuuugaagccaauggaaaccucauugcgccucgcuacgccuucgcucugaauagaggcuuugggagcggaaucauuaacuccaaugcccccauggacaagugugaugcuaaaugccagaccccgcaaggcgccaucaacagcucucuuccuuuccagaauguccaccccgugacaaucggcgaguguccuaaguauguucgguccgcgaaacugcgcauggugaccgggcucagaaacauucccagcauccagucucggggacuguuuggcgccauugcuggguucaucgaaggaggcuggaccgggauggucgacggaugguacggcuaucaucaccagaaugagcaaggcagcggguacgccgcugaucagaaguccacacagaacgccauuaauggaaucacgaacaaagugaacucuguuaucgaaaagaugaauacccaguuuacagccgugggcaaggaguucaacaaacuggagcgcagaauggaaaaucucaacaagaaagucgacgauggguucauugacguguggaccuacaaugcugagcugcuuguccugcucgaaaacgagcggacacuggauuuucacgacagcaaugugaagaaccuuuaugaaaaaguuaagucccaacugaagaauaacgcgaaagagaucggaaauggcugcuucgaguuuuaccauaaguguaacgacgaaugcauggagagcgugaaaaaugggaccuaugauuaccccaaguauucugaagaguccaaacucaaccgcgagaagauugacggcgucaagcuggaaagcaugggaguguaccagauccuggccauuuauucuacgguugcuuccagccucgugcugcuugucucccugggcgccaucucuuucuggaugugcagcaaugggucccuccaguguagaaucugcauuuga

SEQ ID NO: 193384 - RNA, 1701 nt, Artificial Sequence; identical to SEQ ID NO: 185680
  derived and/or modified sequence opt5 from hemagglutinin__InfluenzaA__AGR49877

SEQ ID NO: 193385 - RNA, 1701 nt, Artificial Sequence; identical to SEQ ID NO: 185458
  derived and/or modified sequence opt5 from hemagglutinin__InfluenzaA__AGR49888

SEQ ID NO: 193386 - RNA, 1701 nt, Artificial Sequence
  derived and/or modified sequence opt5 from hemagglutinin__InfluenzaA__AGR49900
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaaguguuacccuuaugacgugcccgauuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaauauccugcccuuaacgucaccaugcccaauaacgagaaguucgacaaacuguacauuuggggcgugcaccauccugggacggauaacgaccagaucuuucucuaugcgcaggccucuggacgcauuacaguuuccaccaagagaagccaacagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugaaugcaucacaccgaacggcagcauuccuaaugacaagcccuuucagaacgugaaucgcaucacguauggcgcuuguccuagauacgucaaacagaacacccugaaacuugccacagggaugcggaauguucccgagaagcaaacccgcggaauuuucggcgcgaucgccggguuuaucgaaaacggaugggagggcaugguggaugggugguauggauucagacaccaaaauuccgagggcauuggccaggcugccgaccugaagucuacacaggcugccaucgaucagauuaacgggaaacucaaucggcugaucggaaagaccaacgaaaaguuccaccagauugagaaagaauuuagcgagguggaaggcagaauccaggaccuugagaaguacgucgaggauacgaaaauugaccugugguccuauaacgccgaacuccugguggcucuggagaaucaacauacaaucgaucucaccgacagcgaaaugaacaagcuguucgagaaaaccaagaagcagcuucgcgaaaaugcggaggauauggggaacggaugcuuuaaaaucuaccacaagugugacaaugccugcauuggcucuauccggaacgggacauaugaucaugacguuuacagagacgaggcucugaauaaccgcuuccagauuaaaggcguggaacucaaguccggauacaaagauuggauccuguggauuagcuuugccaucucuugcuuccuucugugugucgcccuccugggcuuuaucaugugggcuugccagaaggggaauauucgguguaacaucugcauuuga

SEQ ID NO: 193387 - RNA, 1701 nt, Artificial Sequence
  derived and/or modified sequence opt5 from hemagglutinin__InfluenzaA__AGR49912
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagauccuugauggggaaaauuguacccugauugacgcccuccugggagauccccagugcgacggcuuccaaaacaaaaagugggaucuguuugucgagagauccaaagccuauucuaauuguuacccuuaugacgugcccgauuacgcuagccuccggucccugguugccagcucugggacgcuugaguucaacaaugaauccuuuaacuggaccggagugacacagaauggcaccagcucugcuugcauccgcagauccaacaauagcuucuuuucucggcugaacuggcucacacaucugaaguucaaguauccugcccuuaaugucaccaugcccaacaacgaggaauuugacaaacuguacauuuggggcgugcaccauccugggacggauaaugaccagaucuuccucuaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucugcugaucaacagcaccggaaaucucauugcuccucgcggcuacuuuaagaucagaucugggaaauccagcaucaugcggucugacgcccccauuggaaaguguaacagcaagugcaucacaccgaauggcuccauuccuaacgacaaacccuuccagaaugugaaccgcaucacguauggcgcuuguccuagauacgucaagcagaauacccugaaacuugccacagggaugcggaacguucccgagaagcaaacccgcggaauuuuuggcgcgaucgccggguucaucgaaaauggaugggagggcaugguggaugggugguauggauuuagacaccagaacucugagggcauuggccaggcugccgaccugaaaagcacacaagcugccaucgaucagauuaaugggaagcucaaccggcugaucggaaaaaccaacgaaaaguuccaccagauugagaaggaguucuccgaaguggaaggcagaauccaggaccuugagaaauacgucgaggauacgaagauugaccuguggagcuauaaugccgaacuccugguggcucuggagaaccaacauacaaucgaucucaccgacucugaaaugaauaaacuguuugagaagaccaaaaagcagcuucgcgaaaacgcggaggauauggggaauggaugcuucaagaucuaccacaaaugugacaacgccugcauuggcuccauccggaaugggacauaugaucaugacguuuacagagacgaggcucugaacaaucgcuuucagauuaagggcguggaacucaaaagcggauacaaggauuggauccuguggauuucuuucgccaucuccugcuuucuucugugugucgcccuccugggcuucaucaugugggcuugccagaaagggaacauucgguguaauaucugcauuuga

SEQ ID NO: 193388 - RNA, 1701 nt, Artificial Sequence
  derived and/or modified sequence opt5 from hemagglutinin__InfluenzaA__AGR49924
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagauccuugauggggaaaauuguacccugauugacgcccuccugggagauccccagugcgacggcuuccaaaacaaaaagugggaucuguuugucgagagauccaaagccuauucuaauuguuacccuuaugacgugcccgauuacgcuagccuccggucccugguugccagcucugggacgcuugaguucaacaaugaauccuuuaacuggaccggagugacacagaauggcaccagcucugcuugcauccgcagauccaacaauagcuucuuuucucggcugaacuggcucacacaucugaaguucaaguauccugcccuuaaugucaccaugcccaacaacgaggaauuugacaaacuguacauuuggggcgugcaccauccugggacggauaaugaccagaucuuccucuaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucugcugaucaacagcaccggaaaucucauugcuccucgcggcuacuuuaagaucagaucugggaaauccagcaucaugcggucugacgcccccauuggaaaguguaacagcaagugcaucacaccgaauggcuccauuccuaacgacaaacccuuccagaaugugaaccgcaucacguauggcgcuuguccuagauacgucaagcagaauacccugaaacuugccacagggaugcggaacguucccgagaagcaaacccgcggaauuuuuggcgcgaucgccggguucaucgaaaauggaugggagggcaugguggaugggugguauggauuuagacaccagaacucugagggcauuggccaggcugccgaccugaaaagcacacaagcugccguggaucagaucaaugggaagcucaaccggcugauuggaaaaaccaacgaaaaguuccaccagaucgagaaggaguucuccgaagucgaaggccgcauucaggaccuugagaaauacguggaggauacgaagaucgaccuguggagcuauaaugccgaacuccugguugcucuggagaaccaacauacaauugaucucaccgacucugaaaugaauaaacuguuugagaagaccaaaaagcagcuuagagaaaacgcggaggauauggggaauggaugcuucaagaucuaccacaaaugugacaacgccugcaucggcuccauucggaaugggacauaugaucaugacguguacagagacgaggcucugaacaaucgcuuucagaucaagggcgucgaacucaaaagcggauacaaggauuggauucuguggaucucuuucgccauuuccugcuuucuucuguguguggcccuccugggcuucaucaugugggcuugccagaaagggaacauccgguguaauauuugcaucuga

SEQ ID NO: 193389 - RNA, 1701 nt, Artificial Sequence
  derived and/or modified sequence opt5 from hemagglutinin__InfluenzaA__AGR49936
augaagaccaucauugcccugagcuacauccucugccugauuuccgcucagaaauuccccggcaacgacaauucuacagccacgcuuugucuggggcaccaugcggugccuaacggaaccaucgucaagacaauuaccaaugaucaaaucgagguuacaaacgcuaccgaacucgugcagagcuccucuacaggcgagaucugcgacagcccgcaccagauucuggauggggaaaauuguacccuuaucgacgcccugcucggagauccccagugcgacggcuuucaaaacaaaaagugggaucuguucguggagagauccaaagccuauucuaauuguuacccuuaugacguccccggguacgcuagccugcggucccucguggccagcucuggaacgcuggaauuuaacaaugaguccuucaacuggaccggcguuacacagaauggcaccagcucugcuugcauucgcagauccaacaauagcuuuuucucucggcuuaacuggcugacacaucucaaguuuaaguauccugcccugaaugugaccaugcccaacaacgaggaguucgauaaacuuuacaucuggggaguccaccauccugggacggacaaugaucagauuuuucuguaugcgcaggccuccggccgcaucacagugagcaccaagagaucccaacagacaguuauuccgaacaucgggucucggccccgcgugagaaauaucccuagccggauuuccaucuacuggaccauugucaaacccggagacauccuccugauuaacagcaccggcaaucugaucgcuccucgcggguacuucaagaucagaucuggaaaauccagcauuaugcggucugaugcccccaucggcaaguguaacagcgaaugcauuacaccgaauggcuccaucccuaacgacaagcccuuucagaaugugaaccgcauuacguauggggcuuguccuagauacgugaaacagaauacccucaagcuggccacaggaaugcggaacguccccgaaaaacaaacccgcggcaucuucggggcgaucgccggauuuauugagaauggcugggaggggaugguugacggaugguauggcuucagacaccagaacucugaaggcaucgggcaggcugccgaucuuaagagcacacaagcugccauugaccagaucaauggaaaacugaaccggcucauuggcaagaccaacgagaaauuccaccagaucgaaaaggaguuuuccgaaguggaggggcgcauucaggaucuggagaaguacguggaagacacgaaaaucgaucuuuggagcuauaaugccgagcugcucgucgcucuggaaaaccaacauacaaucgaccugaccgauucugagaugaauaaacucuucgaaaagaccaagaaacagcugagagagaacgcggaggacaugggaaauggcugcuuuaagauuuaccacaagugugauaacgccugcaucggguccauucggaauggcacauaugaccaugauguguacagagacgaagcucuuaacaaucgcuuccagaucaaaggaguugagcucaagagcggcuacaaagacuggauucuguggaucucuuuugccaucuccugcuuccugcuuuguguggcccugcucggguuuauuaugugggcuugccagaagggaaacauccgguguaauauuugcaucuga

SEQ ID NO: 193390 - RNA, 1701 nt, Artificial Sequence; identical to SEQ ID NO: 190718
  derived and/or modified sequence opt5 from hemagglutinin__InfluenzaA__AGR49948

SEQ ID NO: 193391 - RNA, 1701 nt, Artificial Sequence; identical to SEQ ID NO: 185551
  derived and/or modified sequence opt5 from hemagglutinin__InfluenzaA__AGR49960

SEQ ID NO: 193392 - RNA, 1701 nt, Artificial Sequence
  derived and/or modified sequence opt5 from hemagglutinin__InfluenzaA__AGR49972
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacaauuguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 193393 - RNA, 1698 nt, Artificial Sequence; identical to SEQ ID NO: 189722
  derived and/or modified sequence opt5 from hemagglutinin__InfluenzaA__AGR49983

SEQ ID NO: 193394 - RNA, 1698 nt, Artificial Sequence; identical to SEQ ID NO: 189722
  derived and/or modified sequence opt5 from hemagglutinin__InfluenzaA__AGR49995

SEQ ID NO: 193395 - RNA, 1701 nt, Artificial Sequence; identical to SEQ ID NO: 185680
  derived and/or modified sequence opt5 from hemagglutinin__InfluenzaA__AGR50007

SEQ ID NO: 193396 - RNA, 1701 nt, Artificial Sequence; identical to SEQ ID NO: 185680
  derived and/or modified sequence opt5 from hemagglutinin__InfluenzaA__AGR50018

SEQ ID NO: 193397 - RNA, 1701 nt, Artificial Sequence; identical to SEQ ID NO: 185680
  derived and/or modified sequence opt5 from hemagglutinin__InfluenzaA__AGR50029

SEQ ID NO: 193398 - RNA, 1701 nt, Artificial Sequence
  derived and/or modified sequence opt5 from hemagglutinin__InfluenzaA__AGR50040
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaugggcucuaucagaaaugggacauaugaucaugacguuuaccgcgacgaggcucugaacaaucgguuccagauuaaaggcguggaacucaaguccggauacaaagauuggauccuguggauuagcuuugccaucucuugcuuccuucugugugucgcccuccugggcuuuauuaugugggcuugccaaaaggggaacaucagauguaauaucugcauuuga

SEQ ID NO: 193399 - RNA, 1701 nt, Artificial Sequence; identical to SEQ ID NO: 185680
  derived and/or modified sequence opt5 from hemagglutinin__InfluenzaA__AGR50052

SEQ ID NO: 193400 - RNA, 1701 nt, Artificial Sequence; identical to SEQ ID NO: 185680
  derived and/or modified sequence opt5 from hemagglutinin__InfluenzaA__AGR50063

SEQ ID NO: 193401 - RNA, 1701 nt, Artificial Sequence
  derived and/or modified sequence opt5 from hemagglutinin__InfluenzaA__AGR50074
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcaaucaggaggggagaaugaacuacuauuggacacugguugaacccggagauaagauuaccuucgaggccacgggcaaccugguggugccucgguacgcguuugccauggaacgcaaugcuggguccggaaucauuaucagcgacacacccguccaugauugcaacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggacggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaccuguacgagaagguccgcucccagcucaaaaauaacgccaaggaaauugggaauggauguuuugaguucuaucacaagugcgauaacaccuguauggaaagcgugaaaaauggcacauacgacuauccuaaguacucugaggaagcuaaacugaacagagaggagaucgaugggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 193402 - RNA, 1701 nt, Artificial Sequence; identical to SEQ ID NO: 185680
  derived and/or modified sequence opt5 from hemagglutinin__InfluenzaA__AGR50085

SEQ ID NO: 193403 - RNA, 1701 nt, Artificial Sequence; identical to SEQ ID NO: 185680
  derived and/or modified sequence opt5 from hemagglutinin__InfluenzaA__AGR50096

SEQ ID NO: 193404 - RNA, 1701 nt, Artificial Sequence; identical to SEQ ID NO: 185680
  derived and/or modified sequence opt5 from hemagglutinin__InfluenzaA__AGR50107

SEQ ID NO: 193405 - RNA, 1701 nt, Artificial Sequence; identical to SEQ ID NO: 185873
  derived and/or modified sequence opt5 from hemagglutinin__InfluenzaA__AGR50118

SEQ ID NO: 193406 - RNA, 1701 nt, Artificial Sequence
  derived and/or modified sequence opt5 from hemagglutinin__InfluenzaA__AGR50129
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggccagugcccuaaguauguuaagagcacgaaacugagacuugcuaccgggcugcggaacgugcccuccauccagucucgcggacucuuuggcgccauugccggguucaucgagggaggcuggacagggaugguggacggaugguacggcuaucaucaccaaaaugaacagggcagcggguacgcugcggaucugaaguccacccagaacgccaucgacgagauuacaaauaaagucaacagcgugaucgagaagaugaauacccaguuuacggcuguuggaaaagaguucaaccaccuugagaagagaauugaaaaucugaacaagaaaguggaugacggcuuccucgauaucuggacauacaaugccgagcugcugguccuccuggaaaacgagcggacccuugacuaucaugauucuaaugugaagaaccuguacgagaaaguccgcucccaacucaagaacaaugccaaagaaauugggaacggauguuuugaguucuaucacaagugcgacaauaccuguauggaaagcgugaagaacggcacauacgauuauccuaaauacucugaggaagcuaagcugaauagagaggagaucgacgggguuaaacuugaauccacccggaucuaucagauucuggccaucuacagcacaguggcguccucucucguccuggugguuagccugggcgcuauuuccuuuuggaugugcucuaacggaagccuccagugccgcaucuguauuuga

SEQ ID NO: 193407 - RNA, 1701 nt, Artificial Sequence; identical to SEQ ID NO: 185680
  derived and/or modified sequence opt5 from hemagglutinin__InfluenzaA__AGR50140

SEQ ID NO: 193408 - RNA, 1701 nt, Artificial Sequence; identical to SEQ ID NO: 185875
  derived and/or modified sequence opt5 from hemagglutinin__InfluenzaA__AGR50151

SEQ ID NO: 193409 - RNA, 1698 nt, Artificial Sequence; identical to SEQ ID NO: 189722
  derived and/or modified sequence opt5 from hemagglutinin__InfluenzaA__AGR50162

SEQ ID NO: 193410 - RNA, 1701 nt, Artificial Sequence; identical to SEQ ID NO: 185680
  derived and/or modified sequence opt5 from hemagglutinin__InfluenzaA__AGR50174

SEQ ID NO: 193411 - RNA, 1701 nt, Artificial Sequence; identical to SEQ ID NO: 185719
  derived and/or modified sequence opt5 from hemagglutinin__InfluenzaA__AGR50185

SEQ ID NO: 193412 - RNA, 1701 nt, Artificial Sequence; identical to SEQ ID NO: 185680
  derived and/or modified sequence opt5 from hemagglutinin__InfluenzaA__AGR50196

SEQ ID NO: 193413 - RNA, 1701 nt, Artificial Sequence
  derived and/or modified sequence opt5 from hemagglutinin__InfluenzaA__AGR50207
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaaaagcuacccuaagcuguccaagagcuauauuaacgacaaagggaaggaagugcuuguccuguggggaauccaccaccccuccaccucugccgaucaacagagccucuaccagaaugcugacgccuacguguucgugggcuccagcagauauucuaaaaaguuuaaaccugagauugcuauccggccgaagguccgcgaucaggaggggagaaugaacuacuauuggacacugguugaacccggagacaaaauuaccuucgaggccacgggcaaucugguggugccucgguacgcguuugccauggaacgcaacgcuggguccggaaucauuaucagcgauacacccguccaugacugcaacaccacaugucaaaccccuaagggcgccaucaauaccucucuccccuuccagaacauucacccgaucacaauuggcaagugcccuaaauauguuaagagcacgaaacugagacuugcuaccgggcugcggaaugugcccuccauccagucucgcggacucuuuggcgccauugccggguucaucgagggaggcuggacagggaugguggacggaugguacggcuaucaucaccagaacgaacaaggcagcggguacgcugcggaucugaaguccacccagaaugccaucgacgagauuacaaacaaagucaauagcgugaucgagaagaugaacacccaguuuacggcuguuggaaaggaguucaaucaccuugagaaaagaauugaaaaccugaauaagaaaguggaugacggcuuccucgauaucuggacauacaacgccgagcugcugguccuccuggaaaaugagcggacccuugacuaucaugauucuaacgugaagaaucuguacgagaaaguccgcucccagcucaagaacaacgccaaggaaauugggaauggauguuuugaguucuaucacaaaugcgacaacaccuguauggaaagcgugaagaauggcacauacgauuauccuaaauacucugaggaagcuaagcugaacagagaggagaucgacgggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 193414 - RNA, 1701 nt, Artificial Sequence; identical to SEQ ID NO: 185680
  derived and/or modified sequence opt5 from hemagglutinin__InfluenzaA__AGR50218

SEQ ID NO: 193415 - RNA, 1701 nt, Artificial Sequence; identical to SEQ ID NO: 185680
  derived and/or modified sequence opt5 from hemagglutinin__InfluenzaA__AGR50229

SEQ ID NO: 193416 - RNA, 1701 nt, Artificial Sequence; identical to SEQ ID NO: 185875
  derived and/or modified sequence opt5 from hemagglutinin__InfluenzaA__AGR50240

SEQ ID NO: 193417 - RNA, 1701 nt, Artificial Sequence; identical to SEQ ID NO: 185733
  derived and/or modified sequence opt5 from hemagglutinin__InfluenzaA__AGR50251

SEQ ID NO: 193418 - RNA, 1701 nt, Artificial Sequence
  derived and/or modified sequence opt5 from hemagglutinin__InfluenzaA__AGR50262
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagaaaacccuugacuaucaugauucuaaugugaagaaccuguacgagaaaguccggucccagcucaagaacaaugccaaggaaauugggaacggauguuuugaguucuaucacaaaugcgacaauaccuguauggaaagcgugaagaacggcacauacgauuauccuaaauacucugaggaagcuaagcugaaucgcgaggagaucgacgggguuaaacuugaauccaccagaaucuaucaaauucuggccaucuacagcacaguggcguccucucucguccuggugguuagccugggcgcuauuuccuuuuggaugugcucuaacggaagccuccagugccggaucuguauuuga

SEQ ID NO: 193419 - RNA, 1701 nt, Artificial Sequence; identical to SEQ ID NO: 185680
  derived and/or modified sequence opt5 from hemagglutinin__InfluenzaA__AGR50273

SEQ ID NO: 193420 - RNA, 1701 nt, Artificial Sequence
  derived and/or modified sequence opt5 from hemagglutinin__InfluenzaA__AGR50284
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauucucccguccaugacugcaauacaaccugucaaacaccuaaaggcgccaucaacaccagccuccccuuccagaauauucacccgaucaccauuggcaagugcccuaaguaugugaaauccacaaagcugagacuugcuacggggcugcggaacguucccucuauccagagccgcggacucuuuggcgccauugccggguucaucgagggaggcuggaccgggaugguggacggaugguacggcuaucaucaccagaaugaacaaggcuccggguacgcugcggaucugaaaagcacacagaacgccaucgacgagauuaccaauaaggucaacucugugaucgagaaaaugaauacacaguuuaccgcuguuggaaaggaguucaaccaccuugagaagagaauugaaaaucugaacaaaaagguggaugacggcuuccucgauaucuggacguacaaugccgagcugcugguccuccuggaaaacgagcggacacuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcaccuacgauuauccuaaguacuccgaggaagcuaaacugaauagagaggagaucgacgggguuaaacuugaaagcacacggaucuaucaaauucuggccaucuacuccaccguggcgucuagccucguccuggugguuucccugggcgcuauuucuuuuuggaugugcagcaacggaucccuccagugccgcaucuguauuuga

SEQ ID NO: 193421 - RNA, 1701 nt, Artificial Sequence; identical to SEQ ID NO: 186423
  derived and/or modified sequence opt5 from hemagglutinin__InfluenzaA__AGR50295

SEQ ID NO: 193422 - RNA, 1701 nt, Artificial Sequence; identical to SEQ ID NO: 185680
  derived and/or modified sequence opt5 from hemagglutinin__InfluenzaA__AGR50306

SEQ ID NO: 193423 - RNA, 1701 nt, Artificial Sequence; identical to SEQ ID NO: 185680
  derived and/or modified sequence opt5 from hemagglutinin__InfluenzaA__AGR50317

SEQ ID NO: 193424 - RNA, 1701 nt, Artificial Sequence; identical to SEQ ID NO: 193413
  derived and/or modified sequence opt5 from hemagglutinin__InfluenzaA__AGR50328

SEQ ID NO: 193425 - RNA, 1701 nt, Artificial Sequence
  derived and/or modified sequence opt5 from hemagglutinin__InfluenzaA__AGR50339
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccucuaaaggcgccaucaacaccagccucccuuuccagaauauucaccccaucacaauuggcaagugcccgaaguaugugaaauccacgaagcugagacuugcuaccgggcugcggaacguuccuucuauccagagccgcggacucuuuggcgccauugccggguucaucgagggaggcuggacagggaugguggacggaugguacggcuaucaucaccagaaugaacaaggcuccggguacgcugcggaucugaaaagcacccagaacgccaucgacgagauuacaaauaaggucaacucugugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauaccuguauggaaucugugaaaaacggcacauacgauuaucccaaguacuccgaggaagcuaaacugaauagagaggagaucgacgggguuaaacuugaaagcacccggaucuaucaaauucuggccaucuacuccacaguggcgucuagccucguccuggugguuucccugggcgcuauuucuuuuuggaugugcagcaacggaucccuccagugccgcaucuguauuuga

SEQ ID NO: 193426 - RNA, 1701 nt, Artificial Sequence
  derived and/or modified sequence opt5 from hemagglutinin__InfluenzaA__AGR50350
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauuaugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucugcccuuccagaauauucacccgaucacaauuggcaagugcccuaaguaugugaaaagcacgaagcucagacuggcuaccgggcuucggaacguucccuccauccagucucgcggacuguuuggcgccauugccggguucaucgagggaggcuggacagggaugguggacggaugguacggcuaucaucaccagaaugaacaaggcagcggguacgcugcggaucucaaauccacccagaacgccaucgacgagauuacaaauaaggucaacagcgugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggaucuaucaaauucuugccaucuacagcacaguggcguccucucugguccucgugguuagccugggcgcuauuuccuuuuggaugugcucuaacggaagccugcagugccgcaucuguauuuga

SEQ ID NO: 193427 - RNA, 1698 nt, Artificial Sequence
  derived and/or modified sequence opt5 from hemagglutinin__InfluenzaA__AGR50361
augaaggugcagcugcucguccugcuuugcaccuucacagccacguacgcugacaccaucuguauuggcuaucacgccaacaauagcacagauaccguugacacagugcuggagaaaaacgugaccgucacacauuccgugaaucuccuggaaaacucucacaaugggaaacuuugccugcucaaaggaaucgcgccccugcaacugggcaacuguagcguugcuggguggauucucggaaauccugagugcgaacugcuuaucuccaaggagucuuggagcuacauuguggaaaaaccgaaccccgagaauggcaccuguuauccugggcauuuugccgauuacgaggaacugagagagcagcucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaagaaugggcucuaccccaaccugucuaaauccuaugcuaauaacaaggagaaagaagugcugguccucuggggagugcaccacccuccgaacaucguggaccagaagacccuguacagaacagagaaugccuacgucagcguuguguccucucauuauagccggaaauucacccccgaaauugcuaagcgcccuaaggugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccaugggcaaaugugaugcuaagugccaaaccccgcagggcgccaucaauuccagccuuccuuuccagaacguccaccccgugacaaucggggaguguccuaaauauguucggucugcgaagcugcgcauggugaccggacucagaaauauucccagcauccagucccggggccuguuuggggccauugcuggauucaucgaaggcggguggaccggaauggucgacggcugguacggcuaucaucaccaaaacgagcaggggucuggauacgccgcugaucagaaaagcacacagaaugccauuaacggcaucacgaauaaggugaacuccguuaucgaaaagaugaauacccaauuuacagccguggggaaggaguucaacaagcuggagcgcagaauggaaaaccucaauaaaaaggucgacgauggauucauugacaucuggaccuacaacgcugagcugcuugugcugcucgaaaaugagcggacacuggauuuucacgacagcaacgucaaaaaucuuuaugaaaaggugaaaucucagcugaagaacaaugcgaaggagauuggcaacgggugcuucgaguuuuaccauaaauguaaugacgaaugcauggaguccguuaagaacggcaccuaugauuaccccaaauauagcgaagagucuaagcucaaucgcgagaaaaucgacggagugaagcuggaauccaugggcgucuaccagauucuggccaucuauagcacgguggcuuccucucucguucugcuugugagccugggggccaucuccuucuggaugugcucuaacggaagccuccaauguagaauuugcaucuga

SEQ ID NO: 193428 - RNA, 1701 nt, Artificial Sequence
  derived and/or modified sequence opt5 from hemagglutinin__InfluenzaA__AGT18718
augaaggugauccuggucguucuccuguacaccuucgccacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauuaauuacgaagaacugcgggagcagcuuuccagcgugucuuccuucgaacgcuuugagaucuuccccaagaccagcucuuggccuaaccacgacuccaauaagggaguuacagcugccuguccccaugcuggcgccaagagcuuuuauaagaaccugaucuggcucgugaaaaagggcaauucuuacccuaaacuguccaagagcuauauuaacgauaaggggaaagaaguccuugugcuguggggaauccaccaccccuccaccacagcggaccaacagucucucuaccagaaugccgaugcuuacguguucgucggcaccagcagauauuccaagaaauuuaagccugagauugccauccggccgaaaguucgcgaccaggaggggagaaugaacuacuauuggacgcugauugaacccggagauaagaucacauucgaggcuaccggcaaccugguggugccucgguacgccuuugcgauggaacgcaaugccgggagcggaauuaucaucucugacacacccguccaugauugcaacaccaccugucaaacaccugagggcgcuauuaauacgucccuccccuuccagaacauccacccgauuaccaucggcaaaugcccuaaguaugugaaaagcacaaaacugagacuugccaccgggcugcggaauguucccucuauucagagccgcggacucuuuggcgcuaucgccggguucaucgaaggaggcuggacagggaugguggacggaugguacggcuaucaucaccagaacgagcaaggcuccggguacgccgcugaccugaagucuacccagaaugcgauugauaaaaucacgaacaaggucaauagcgugauugagaaaaugaacacacaguuuaccgccguuggaaaggaguucaaucaccuugagaagagaaucgaaaaccugaauaaaaagguggacgauggcuuccucgacauuuggaccuacaacgcugagcugcugguccuccuggaaaaugagcggacacuugauuaucaugacuccaacgugaaaaaccuguacgagaagguccgcaaucagcucaaaaacaaugccaaggaaaucgggaacggauguuuugaguucuaucacaagugcgauaauaccuguauggaaagcgugaaaaacggcacauacgacuauccuaaguacucugaggaagccaaacugaauagagagaagaucgaugggguuaaacuugaguccacgcggauuuaucaaauccuggcuauuuacagcaccguggccucuucccucguccuggugguuagccugggcgcgaucuccuuuuggaugugcucuaacggaagccuccagugccgcauuuguaucuga

SEQ ID NO: 193429 - RNA, 1701 nt, Artificial Sequence
  derived and/or modified sequence opt5 from hemagglutinin__InfluenzaA__AGT18720
augaaggugauccuggucguucuccuguacaccuucgccacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauuaauuacgaagaacugcgggagcagcuuuccagcgugucuuccuucgaacgcuuugagaucuuccccaaggcuagcucuuggccuaaccacgacuccaauaagggaguuaccgccgcuuguccccaugccggcgcgaaaucuuuuuauaagaaccugaucuggcucgugaaaaagggcaauagcuacccuaaacuguccaagagcuauauuaacgauaaggggaaagaaguccuugugcuguggggaauccaccaccccaauacaaccgccgaccaacagucccucuaccagaacgcugaugccuacguguucgucggcacaucuagauauagcaagaaauuuaagccugagauugcuauccggccgaaaguucgcgaccaggagagacggaugaacuacuauuggacccugauugaacccggggauaagaucacguucgaggccacaggaaaucugguggugccucgcuacgcguuugccauggaaagaaacgcuggcuccgggauuaucaucagcgacacccccguccaugauugcaauacaaccugucaaaccccugagggagccauuaacacaucucuccccuuccagaauauccacccgauuacgaucggcaaaugcccuaaguaugugaaguccaccaaacugcggcuugcuacaggccugcgcaacguucccagcauucagucuagagggcucuuuggagccaucgccggcuucaucgaagggggauggaccggcaugguggacgggugguacggauaucaucaccagaaugagcaaggcagcggcuacgcugcggaccugaaguccacacagaacgccauugauaaaaucaccaauaaggucaacucugugauugagaaaaugaauacgcaguuuacagcuguugggaaggaguucaaccaccuugagaagcggaucgaaaaucugaacaaaaagguggacgauggauuccucgacauuuggaccuacaaugccgagcugcugguccuccuggaaaacgagcgcacccuugauuaucaugacagcaacgugaaaaaucuguacgagaaggucagaaaccagcucaaaaauaacgccaaggaaaucggcaauggguguuuugaguucuaucacaagugcgauaacacauguauggaauccgugaaaaauggaaccuacgacuauccuaaguacagcgaggaagcuaaacugaaccgggagaagaucgauggcguuaaacuugagucuacacgcauuuaucaaauccuggccauuuacuccacgguggcgagcucucucguccuggugguuucccugggggcuaucagcuuuuggaugugcuccaauggcucucuccagugcagaauuuguaucuga

SEQ ID NO: 193430 - RNA, 1701 nt, Artificial Sequence
  derived and/or modified sequence opt5 from hemagglutinin__InfluenzaA__AGT18721
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaggaacugcgggagcagcuuuccagcgucucuuccauccaacgcagcgaaaucuguaccaagacaucuuccuggcccaaccacgacagcaauaagggagugaccgccgcuugcccucaugccggcgcgaaaucuuucuauaagaaccugauuuggcucguuaaaaagggcaauuccuaccccaaacugagcaaguccuauaucaacgauaaggggaaagaggugcuuguccuguggggcauucaccaccaaaauucuagaggacaucagcagagccucuaccagaacgccgacgcuuacguguuuguggggacaucccgguauagcaagaaauucaagccugaaaucgccauucgccccaaagucaaggagcaggauggaagaauggacuacuauuggacccugaucgagccuggcgauaaaauuacguuugaagcuacagggaaccugguugugccgcgguacgccuucgcgauggagcgcaaugccggaucuggcaucaucauuuccgacacccccgugcacgauuguaacacaaccugccagaccccugaaggcgcuaucaauacaagccuccccuuucagaacauucauccuaucacgauugggaagugucccaaguaugucaaaucuaccaagcugagacuugccacaggacugcggaaugugccgagcauccaaucccgcggccucuucggggcuaucgccggauuuauugagggcggguggaccggaaugguugacggcugguacggcuaucaccaccagaacgaacaggggucuggauacgccgcugaccugaaaagcacacagaaugcgaucgauaagauuaccaacaaagucaauuccgugaucgagaagaugaacacgcaauucacagccgugggcaaggaguuuaaucaucuugaaaagagaauugagaaccugaauaagaaaguugacgauggguuccucgacaucuggaccuacaacgcugaacugcuggugcuccuggagaaugaacggacccuugauuaucacgacagcaacgucaagaaccuguacgagaaagugcgcaaucagcucaagaacaaugccaaggagaucggaaacggcugcuuugaguucuaucauaaaugugauaauacaugcauggaaucugucaagaacgggaccuacgacuauccuaaauacuccgaagaggccaagcugaauagagagaaaauugauggcgugaaacuugaaagcacacggaucuaucagauucuggcuaucuacucuacgguugccuccagccucgugcuggucgugucccugggagcgauuucuuucuggaugugcagcaacggcucccuccaaugucgcaucugcauuuga

SEQ ID NO: 193431 - RNA, 1701 nt, Artificial Sequence
  derived and/or modified sequence opt5 from hemagglutinin__InfluenzaA__AGT18722
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaagucuaacaaucggacgugcuauccgggcgacuuuauuaacuacgaagaacugcgcgagcagcuuagcuccgucagcucuuucgaaagauuugagaucuuccccaagaccuccagcuggccuaaucacgauucuaacaaaggggugacagccgcuuguccccaugccggagcgaaguccuuuuauaaaaaucugaucuggcucguuaagaaaggcaacagcuacccuaagcugucuaaguccuauauuaaugacaaaggcaaggaagugcuuguccugugggggauccaccaccccagcaccacagccgaucaacagucccucuaccagaacgcugacgccuacguguucgugggaaccucucgguauagcaaaaaguuuaaaccugagauugcuauccgcccgaaggucagagaucaggagggccggaugaacuacuauuggacgcugauugaacccggggacaaaaucacauucgaggccaccggaaaucugguugugccucgcuacgcguuugccauggaaagaaacgcuggcuccgggauuaucaucagcgauacacccgugcaugacugcaauaccaccugucaaacaccugagggagccauuaacacgucucuccccuuccagaauauccacccgauuaccaucggcaagugcccuaaguaugucaaauccacaaagcugcggcuugcuaccggccugcgcaacgugcccagcauucagucuagagggcucuuuggagccaucgccggcuucaucgaagggggauggacaggcaugguugaugggugguacggauaucaucaccagaaugagcaaggcagcggcuacgcugcggaccugaaauccacccagaacgccauugacaagaucacgaauaaagugaacucugucauugagaagaugaauacacaguuuaccgcuguggggaaggaguucaaccaccuugagaaacggaucgaaaaucugaacaagaaaguugaugacggauuccucgauauuuggaccuacaaugccgagcugcuggugcuccuggaaaacgagcgcacacuugacuaucaugauagcaacgucaagaaucuguacgagaaagugagaaaccagcucaagaauaacgccaaggaaaucggcaauggguguuuugaguucuaucacaaaugcgacaacaccuguauggaauccgucaagaauggaacauacgauuauccuaaauacagcgaggaagcuaagcugaaccgggagaaaaucgacggcgugaaacuugagucuacgcgcauuuaucaaauccuggccauuuacuccaccguugcgagcucucucgugcuggucgugucccugggggcuaucagcuuuuggaugugcuccaauggcucucuccagugcagaauuuguaucuga

SEQ ID NO: 193432 - RNA, 1701 nt, Artificial Sequence
  derived and/or modified sequence opt5 from hemagglutinin__InfluenzaA__AGT18723
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccaagacgaacaaucggaccugcuauccgggcgacuuuauuaacuacgaagaacugcgcgagcagcuuucuagcgucuccagcuucgaaagauuugagaucuuccccaagacaucuuccuggccuaaucacgauagcaacaaaggggugaccgccgcuuguccccaugccggagcgaagucuuuuuauaaaaaucugaucuggcucguuaagaaaggcaacuccuacccuaagcugagcaagucuuauauuaaugacaaaggcaaggaagugcuuguccugugggggauccaccaccaaaacaaaaaggccgagcagcagacacccuaccagaacgcugaugccuacguguucgugggaaccucccgguauagcaaaaaguuuaaaccugagauugcuauccgcccgaaggucagagaccaagaaggccggauggauuacuauuggacgcucauugagcccggggacaagaucacauucgaagccaccggaaaucugguugugccucgcuacgcguuugccauggagagaaacgcuggcuccgggauuaucaucucugauacacccgugcaugacugcaauaccaccugucagacaccugaaggagccauuaacacgagccugcccuuccagaauauccacccgauuaccaucggcaaaugcccuaaguaugucaaauccacaaagcuccggcuggcuaccggccuucgcaacgugcccagcauucagucuagagggcuguuuggagccaucgccggcuucaucgaagggggauggacaggcaugguugaugggugguacggauaucaucaccaaaaugagcagggcuccggcuacgcugcggaccucaaaagcacccagaacgccauugacaagaucacgaauaaggugaacucugucauugagaaaaugaauacacaguuuaccgcuguggggaaggaguucaaccaccuggaaaaacggaucgagaaucuuaacaagaaaguugaugacggauuccuggauauuuggaccuacaaugccgaacuccuggugcugcucgagaacgagcgcacacuggacuaucaugauagcaacgucaagaaucuuuacgaaaaggugagaaaccaacugaaaaauaacgccaaggagaucggcaauggguguuuugaguucuaucacaaaugcgacaacaccuguauggaguccgucaagaauggaacauacgauuauccuaaauacucugaagaggcuaagcucaaccgggagaagaucgacggcgugaaacuggaaagcacgcgcauuuaucagauccuugccauuuacuccaccguugcgagcucucuggugcucgucgugucccugggggcuaucagcuuuuggaugugcucuaauggcucccugcagugcagaauuuguaucuga

SEQ ID NO: 193433 - RNA, 1701 nt, Artificial Sequence
  derived and/or modified sequence opt5 from hemagglutinin__InfluenzaA__AGT18724
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugugccccuccaucugggcaaaugcaacaucgccggguggauucugggaaauccugagugugaaucucucagcacagccuccucuuggagcuacaucgucgagaccuccaagacgaacaaucggaccugcuauccgggcgacuuuauuaacuacgaagaacugcgcgagcagcuuucuagcguguccagcuucgaaagauuugagaucuuccccaagacaucuuccuggccuaaucacgauagcaacaaagggguuaccgcugccuguccccaugcuggagccaagucuuuuuauaaaaaucugaucuggcucgugaagaaaggcaacuccuacccuaagcugagcaagucuuauauuaaugacaaaggcaaggaaguccuugugcugugggggauccaccaccccuccacaaccgcggaucaacagacgcucuaccagaacgccgacgcuuacguguucgucggaacaagccgguauuccaaaaaguuuaaaccugagauugccauccgcccgaagguuagagaucaggagggccggaugaacuacuaucgcacccugauugaacccgagaauaaaaucacauucgaagcuaccgggaaccugguggugccuagauacgccuuugcgauggagcggaaugccggaucuggcauuaucaucagcgacacccccguccaugauugcaacacaacgugucaaaccccugaaggggcuauuaauacaucccuccccuuccagaacauccacccgauuaccaucggaaagugcccuaaguaugugaaaagcacaaagcugcgccuugccaccggccugagaaauguucccucuauucagucccggggccucuuuggggcuaucgccggauucaucgagggcggguggacgggaaugguggacggcugguacggguaucaucaccagaacgagcaaggaagcggcuacgccgcugaucugaaaucuacacagaaugcgauugacaagaucaccaacaaagucaauagcgugauugaaaagaugaacacccaguuuacagccguuggcaaggaguucaaucaccuugaaaaacgcaucgagaaccugaauaagaaaguggacgauggguuccucgacauuuggaccuacaacgcugaacugcugguccuccuggagaacgagagaacacuugauuaucaugacuccaaugugaagaaccuguacgaaaaaguccggaaucagcucaagaacaaugccaaggagaucggaaacggcuguuuugaguucuaucacaaaugcgauaauacguguauggagucugugaagaacgggaccuacgacuauccuaaauacagcgaagaggccaagcugaaucgcgagaaaaucgauggaguuaaacuugaauccacaagaauuuaucaaauccuggcuauuuacagcaccguggccucuucccucguccuggugguuagccugggcgcgaucucuuuuuggaugugcuccaacgggagccuccagugccggauuuguaucuga

SEQ ID NO: 193434 - RNA, 1701 nt, Artificial Sequence
  derived and/or modified sequence opt5 from hemagglutinin__InfluenzaA__AGT18725
augaaggugauccuggucguucuccuguacaccuucgccacagcuaacgccgacacgcuuugcauuggcuaucacgcgaauaacagcaccgauacaguggacaccgugcuggagaaaaaugucacagugacccauuccguuaaccuccuggaagauaagcacaaugggaaacuuuguaagcugagaggaguggcuccccuccaucugggcaaaugcaacaucgccggguggauucugggaaauccugagugugaaucucucagcacagccuccucuuggagcuacaucgucgagaccuccucuagcgacaacggcacgugcuauccgggggauuuuauuaauuacgaagaacugcgggagcagcuuuccagcgugucuuccuucgaacgcuuugagaucuuccccaagaccagcucuuggccuaaccacgacuccaauaagggaguuacagcugccuguccccaugcuggcgccaaauccuuuuauaagaaccugaucuggcucgugaaaaagggcaauucuuacccuaaacuguccaagagcuauauuaacgauaaggggaaagaaguccuugugcuguggggaauccaccaccccuccaccucugcggaccaacagagccucuaccagaaugccgaugcuuacguguucgucggcacauccagauauagcaagaaauuuaagccugagauugccauccggccgaaaguucgcgaccaggaggggagaaugaacuacuauuggacccugguggaacccggagauaagauuacguucgaggcuacaggcaaccugguggucccucgguacgccuuugcgauggaacgcaaugccgggucuggaaucauuaucuccgacacccccgugcaugauugcaacacaaccugucaaaccccugagggcgcuaucaauacaagccuccccuuccagaacauucacccgaucacgauuggcaaaugcccuaaguauguuaagucuaccaaacugagacuugccacagggcugcggaaugugcccagcauccagucccgcggacucuuuggcgcuauugccggguucaucgaaggaggcuggaccgggauggucgacggaugguacggcuaucaucaccagaacgagcaaggcucuggguacgccgcugaccuuaagagcacacagaaugcgaucgauaaaauuaccaacaaggugaauagcguuaucgagaaaaugaacacgcaguuuacagccgugggaaaggaguucaaucaccuggagaagagaauugaaaaccugaauaaaaaggucgacgauggcuuccucgacaucuggaccuacaacgcugagcugcuggugcuccuggaaaaugagcggacccuugauuaucaugacagcaacgucaaaaaccuguacgagaaggugcgcacacagcucaaaaauaacgccaaggaaauugggaauggauguuuugaguucuaucacaagugcgauaacaccuguauggaaucuguuaaaaauggcacauacgacuauccuaaguacuccgaggaagccaaacugaacagagagaagaucgauggggugaaacuugagagcacgcggaucuaucaaauucuggcuaucuacucuaccgucgccuccagccucgugcugguugugucccugggcgcgauuucuuuuuggaugugcagcaauggaucccuccagugccgcaucuguauuuga

SEQ ID NO: 193435 - RNA, 1701 nt, Artificial Sequence
  derived and/or modified sequence opt5 from hemagglutinin__InfluenzaA__AGT18734
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacagccgaccaacagucucucuaccagaaugcugaugccuacguguucgugggcaccagcagauauuccaagaaauuuaagccugagauugcuauccggccgaaaguccgcgaccaggaggggagaauuaacuacuauuggacgcugaucgaacccggagauaagauuacauucgaggccaccggcaaccugguugugccucgguacgcguuugccauggaacgcaaugcugggagcggaaucaucauuucugacacacccgugcaugauugcaacaccaccugucaaacaccugagggcgccaucaauacgucccuccccuuccagaacauucacccgaucaccauuggcaaaugcccuaaguaugucaagagcacaaaacugagacuugcuaccgggcugcggaaugugcccucuauccagagccgcggacucuuuggcgccaucgccggguucauugaaggaggcuggacagggaugguugacggaugguacggcuaucaucaccagaacgagcaaggcuccggguacgcugcggaccugaagucuacccagaaugccaucgauaaaauuacgaacaaggugaauagcgucaucgagaaaaugaacacacaguuuaccgcugugggaaaggaguucaaucaccuugagaagagaauugaaaaccugaauaaaaagguugacgauggcuuccucgacaucuggaccuacaacgccgagcugcuggugcuccuggaaaaugagcggacacuugauuaucaugacuccaacgucaaaaaccuguacgagaaggugcgcaaucagcucaaaaacaaugccaaggaaaucgggaacggauguuuugaguucuaucacaagugcgauaauaccuguauggaaagcgucaaaaacggcacauacgacuauccuaaguacucugaggaagcuaaacugaauagagagaagauugauggggugaaacuugaguccacgcggaucuaucaaauucuggccaucuacagcaccguugcgucuucccucgugcuggucgugagccugggcgcuauuuccuuuuggaugugcucuaacggaagccuccagugccgcaucuguauuuga

SEQ ID NO: 193436 - RNA, 1701 nt, Artificial Sequence; identical to SEQ ID NO: 193147
  derived and/or modified sequence opt5 from hemagglutinin__InfluenzaA__AGT18735

SEQ ID NO: 193437 - RNA, 1701 nt, Artificial Sequence
  derived and/or modified sequence opt5 from hemagglutinin__InfluenzaA__AGT18748
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugaugaagagaacuguacacugaucgacgcccuccugggggauccccagugcgacgauuuucagaauaaaaagugggaccuguucgucgaacggucuaaagccuauagcaacuguuacccuuaugaugugcccgacuacgcuucccuccgcucucugguugccagcuccggaacccuugaguuuaauaacgagagcuucaauugggcuggcgugacgcaaaacgggaccucuuccgccugcagacggggaagcaauucuuccuuuuucagccgccugaacuggcucacacaucugaauuuuaaguauccugcgcuuaacgucaccaugcccaacaaugaacaguucgauaagcuguacauuuggggcgugcaccauccuucuacagacaaagaucagaucuuucucuaugcccaguccagcggcagaauuaccguuuccacgaagcggucucaacaggcugugaucccgaacauugggagccgccccagaauccggaauaucccuucccgcauuagcaucuacuggacaauugucaaacccggagacauccugcugauuaacucuaccggcaaucucaucgccccuagaggguacuucaagauccgguccggaaaaagcucuauuaugcgcagcgacgcucccaucggcaaguguaaguccgagugcauuacaccgaacgggucuaucccuaaugauaaacccuuucagaacgugaauagaauuaccuauggagccuguccucgguacgugaagcagagcacccugaaacuugcgacaggcaugcgcaacguccccgaaaagcaaacgagaggcaucuucggggccaucgcuggauuuauugagaauggcugggaggggaugguugacggaugguauggcuuccggcaccagaacuccgaagggagaggacaggccgcugaucugaaaagcacccaagccgccaucgaccagauuaauggcaagcucaaccgccugaucggcaaaacaaaugagaaguuccaccagauugaaaaggaguuuucugaaguggaggggcggauccaggaucuugagaaauacguggaagacaccaagauugaucugugguccuauaacgcugagcuccuggucgcgcuggaaaaccaacauacaaucgaccucaccgauagcgagaugaauaaacuguucgaaaagacgaaaaagcagcuuagagagaacgccgaggacaugggaaauggcugcuuuaagaucuaccacaaaugugauaacgcuugcauugggucuauccgcaauggaacauaugaccaugacguguaccgggaugaagcccugaacaauagauuccagauuaagggcguugagcucaaauccggguacaaggacuggauccuguggauuagcuuugccaucuccugcuuccuucuguguguggcucuccugggcuuuaucaugugggccugccagaaaggaaacauucgcuguaauaucugcauuuga

SEQ ID NO: 193438 - RNA, 1701 nt, Artificial Sequence
  derived and/or modified sequence opt5 from hemagglutinin__InfluenzaA__AGT18749
augaagaccaucauugcccugagcuacauccucugccugguguucgcucagaaacuucccgagaacgacaauuccacagccacgcugugucucggccaccaugcggucccuaacgggaccauuguuaagacaaucaccgaugaccaaauugaagugacaaaugcuaccgagcuggugcagaacucuagcacaggagaaaucugcgauuccccgcaccagauccuugacggcgagaauuguacccugauugaugcccuccugggggacccccagugcgauggauuucaaaacaaaaagugggaccuguucgucgaaagaucuaaagccuauagcaauuguuacccuuaugaugugcccgacuacgcuucccuccggucucugguugccagcuccggcacgcuugaguuuaacaaugagagcuucaacuggaccggggugacacagaauggaaccucuuccgcuugcauccgcagaagcaacaauuccuuuuucucucggcugaacuggcucacacaucugaauuuuaaguauccugcccuuaacgucaccaugcccaacaaugaacaguucgauaagcuguacauuuggggcgugcaccauccuggcacggacaaagaucagaucuuucucuaugcgcaagccagcgggcgcauuacaguuucuaccaagagaucccagcaggcugugaucccgaacauuggaagccggccccgcgucagaaauaucccuucccggaucucuauuuacuggacaaucgugaaacccggcgacauucugcugaucaacagcaccgggaaucucauugccccucgcggauacuucagaauccgguccggccgcagcucuaucaugagauccgacgcucccauugggaaguguaacagcgagugcaucaccccgaauggaucuauuccuaacgauaaacccuuucagaaugugaaccggaucacauauggcgccuguccucgcuacgucaagcaaaauacgcugaaacuugcgaccggcaugagaaacguucccgaaaaacagacacgggggauuuucggagccaucgcuggcuuuaucgagaaugggugggagggaaugguggacggcugguauggguucagacaccagaacagcgaaggacgcggccaagccgcugaucugaaguccacccaggccgccauugaccagaucaauggcaaacucaaccggcugauugggaagacaaacgagaaauuccaccagaucgaaaaggaguuuucugaaguggagggacgcauucaagaucuugagaaauacgucgaagacaccaagaucgaucuguggagcuauaaugcugagcuccugguggcgcuggaaaaccagcauacgauugaccucacagauuccgagaugaauaagcuguucgaaaagaccaagaaacagcuuagagagaacgccgaggacaugggcaaugggugcuuuaagaucuaccacaaaugugauaacgcuugcaucggaagcauucggaauggcaccuaugaccaugacguuuacagagaugaagcccugaacaaucgcuuccagaucaaggggguggagcucaagucuggcuacaaagacuggauucuguggaucuccuuugccauuagcugcuuccuucugugugucgcucuccugggauuuaucaugugggccugccaaaagggcaacauccgguguaauauuugcaucuga

SEQ ID NO: 193439 - RNA, 1701 nt, Artificial Sequence
  derived and/or modified sequence opt5 from hemagglutinin__InfluenzaA__AGT18751
augaagaccgugaucgcccugagcuacauucucugccuggucuucgcucagaaacuucccggcaacgacaauuccacagccacgcugugucucgggcaccaugcgguuccuaacggaaccaucgugaagacaauuaccaaugaucaaaucgaggugacaaacgcuaccgaacugguccaaaauucuagcacaggcgagauuugcgacuccccgcaccagauccuugauggggaaaacuguacccugaucgacgcccuccugggagauccccagugcgacggcuuucagaauaaaaagugggaucuguucguggagagaucuaaagccuauagcaacuguuacccuuaugacguucccgauuacgcuucccuccggucucugguggccagcuccgggacgcuugaauuuaauaacgagagcuucaauuggaccggagucacacagaacggcaccucuuccgcuugcauucgcagaagcaauaacuccuuuuucucucggcugaauuggcucacacaucugaacuuuaaguauccugcccuuaacgugaccaugcccaauaacgagcaguucgacaagcuguacaucuggggcguucaccauccugggacggauaaagaccagauuuuucucuaugcgcaagccagcggacgcaucacagugucuaccaagagaucccagcaggcugucauuccgaauaucggcagccggccccgcgugagaaacauuccuucccggaucucuaucuacuggacaauugugaaacccggggauauccugcugauuaauagcaccggaaaccucaucgccccucgcggcuacuucaagauuagauccgggcggagcucuaucaugcgcuccgacgcucccaucggaaaauguaauagcgaaugcauuaccccgaacggcucuaucccuaaugacaagcccuuucagaacgucaauagaauuacauauggcgccuguccucgguacguuaagcaaaacacgcugaaacuugcgaccgggaugcgcaaugugcccgagaagcagacaagaggaaucuucggcgccauugcuggguuuaucgaaaacggaugggagggcaugguggaugggugguauggauuccggcaccagaauagcgagggcagaggccaagccgcugaccugaaauccacccaggccgccaucgaucagauuaacgggaagcucaaccgccugaucggaaaaacaaaugaaaaguuccaccagauugagaaagaauuuucugaggucgaaggccggauccaagaccuugagaaguacguggaggauaccaagauugaccuguggagcuauaaauccgaacuccugguugcucuggagaaccagcauacgaucgaucucacagacagcgaaaugaauaagcuguucgagaaaaccaagaaacagcuuagagaaaacgcggaggauauggggaauggaugcuuuaagauuuaccacaagugugacaacgccugcaucggcucuauccgcaaugggaccuaugaucaugacguguaccgggacgaggcucugaacaauagauuccagauuaaaggcgucgaacucaaguccggauacaaagauuggauccuguggauuagcuuugccaucucuugcuuccuucuguguguggcccuccugggcuuuauuaugugggcuugccaaaaggggaacauccgcuguaauaucugcauuuga

SEQ ID NO: 193440 - RNA, 1701 nt, Artificial Sequence
  derived and/or modified sequence opt5 from hemagglutinin__InfluenzaA__AGT18752
augaagaccaucauugcccugagcuacaucauuugccucguguucgcucagaaacugcccggcaacgacaauuccacagccacgcuuugucuggggcaccaugcggucccuaacggaaccaucguuaagacaauuaccaaugaucaaaucgaggugacaaacgcuaccgaacucgugcaaaauucuagcacaggcgagaucugcaacuccccgcaccagauucuggacggggaaaauuguacccuuaucgaugcccugcucggagacccccagugcgauggcuuucagaacaaaaagugggaccuguucgucgagagaucuaaagccuauagcaauuguuacccuuaugaugugcccgacuacgcuucccugcggucucucguugccagcuccgggacgcuggaauuuaacaaugagagcuucaacuggaccggagugacacagaauggcaccucuuccgcuugcauucgcagaagcaacaauuccuuuuucucucggcuuaacuggcugacacaucucaacuuuaaguauccugcccugaaugucaccaugcccaacaaugagcaguucgauaaacuuuacaucuggggcgugcaccauccugggacggacaaggaucagauuuuucuguaugcgcaagccagcggacgcaucacaguuucuaccaagagaucccagcaggcugugauuccgaacaucggcagccggccccgcgucagaaauaucccuucccggauuucuaucuacuggacaauugugaaacccggggacauccuccugauuaacagcaccggaaaucugaucgccccucgcggcuacuucaagaucagauccgggcggagcucuauuaugcgcuccgaugcucccaucggaaaauguaacagcgaaugcauuaccccgaauggcucuaucccuaacgacaagcccuuucagaaugugaacagaauuacauauggcgccuguccucgguacgucaagcaaaauacgcucaaacuggcgaccgggaugcgcaacguucccgagaagcagacaagaggaaucuucggcgccaucgcuggguuuauugaaaauggaugggagggcaugguggacgggugguauggauuccggcaccagaacagcgagggcagaggccaagccgcugaucuuaaauccacccaggccgccaucgaccagauuaacgggaagcugaaucgccucaucggaaaaacaaacgaaaaguuccaccagauugagaaagaauuuucugagguggaaggccggauccaagaucuggagaaguacgucgaggacaccaagauugaucuuuggagcuauuccagcgaacugcucguggcucuggagaaucagcauacgaucgaccugacagauucugaaaugaacaaacucuucgagaagaccaaaaagcagcugagagaaaaugcggaggacauggggaacggaugcuuuaaaaucuaccacaagugugauaaugccugcauuggcuccauccgcaacgggaccuaugaccaugauguuuaccgggacgaggcucuuaauaacagauuccagauuaagggcguggaacugaaaagcggauacaaggacuggauccucuggauuucuuuugccaucuccugcuuccugcuuugugucgcccugcucggcuuuaucaugugggcuugccaaaaagggaauauucgcuguaacaucugcauuuga

SEQ ID NO: 193441 - RNA, 1701 nt, Artificial Sequence
  derived and/or modified sequence opt5 from hemagglutinin__InfluenzaA__AGT18753
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgagaucugcaacuccccgcaccagauccuugacggggaaaauuguacccugauugaugcccuccugggagacccccagugcgauggcuuucagaacaaaaagugggaccuguucgucgagagaucuaaagccuauagcaauuguuacccuuaugaugugcccgacuacgcuucccuccggucucugguugccagcuccgggacgcuugaauuuaacaaugagagcuucaacuggaccggagugacacagaauggcaccucuuccgcuugcauccgcagaagcaacaauuccuuuuucucucggcugaacuggcucacacaucugaacuuuaaguauccugcccuuaaugucaccaugcccaacaaugagcaguucgauaagcuguacauuuggggcgugcaccauccugggacggacaaagaucagaucuuucucuaugcgcaagccagcggacgcauuacaguuucuaccaagagaucccagcaggcugugaucccgaacauuggcagccggccccgcgucagaaauaucccuucccggaucucuauuuacuggacaaucgugaaacccggggacauucugcugaucaacagcaccggaaaucucauugccccucgcggcuacuucaagaucagauccgggcggagcucuaucaugcgcuccgaugcucccauuggaaaauguaacagcgaaugcaucaccccgaauggcucuauuccuaacgacaagcccuuucagaaugugaacagaaucacauauggcgccuguccucgguacgucaagcaaaauacgcugaaacuugcgaccgggaugcgcaacguucccgagaagcagacaagaggaauuuucggcgccaucgcuggguuuaucgaaaauggaugggagggcaugguggacgggugguauggauuccggcaccagaacagcgagggcagaggccaagccgcugaucugaaauccacccaggccgccauugaccagaucaacgggaagcucaaucgccugauuggaaaaacaaacgaaaaguuccaccagaucgagaaagaauuuucugagguggaaggccggauucaagaucuugagaaguacgucgaggacaccaagaucgaucuguggagcuauaaauccgaacuccugguggcucuggagaaucagcauacgauugaccucacagauagcgaaaugaacaagcuguucgagaaaaccaagaaacagcuuagagaaaaugcggaggacauggggaacggaugcuuuaagaucuaccacaagugugauaaugccugcaucggcucuauucgcaacgggaccuaugaccaugauguuuaccgggacgaggcucugaauaacagauuccagaucaaaggcguggaacucaaguccggauacaaagacuggauucuguggaucagcuuugccauuucuugcuuccuucugugugucgcccuccugggcuuuaucaugugggcuugccaaaaggggaauauccgcuguaacauuugcaucuga

SEQ ID NO: 193442 - RNA, 1701 nt, Artificial Sequence
  derived and/or modified sequence opt5 from hemagglutinin__InfluenzaA__AGT18754
augaagaccaucauugcccugagcuacauccucugccugguguucgcucagaaacuucccgagaacgacaauuccacagccacgcugugucucggccaccaugcggucccuaacgggaccauuguuaagacaaucaccgaugaccaaauugaagugacaaaugcuaccgagcuggugcagaacucuagcacaggagaaaucugcgauuccccgcaccagauccuugacggcgagaauuguacccugauugaugcccuccugggggacccccagugcgauggauuucaaaacaaaaagugggaccuguucgucgaaagaggcaaagccuauucuaauuguuacccuuaugaugugcccgacuacgcuagccuccggucccugguugccacgucugggacccuugaguuuaacaaugagagcuucaacuggacaggagugacccagaauggcacauccagcgcuugcauccgcagaucuaacaauuccuuuuucagccggcugaacuggcucacccaucugaauuuuaaguauccugcccuuaacgucacgaugcccaacaaugaacaguucgauaagcuguacauuuggggcgugcaccauccugggacagacaaagaucagaucuuucucuaugcgcaagccucuggacgcauuaccguuuccacaaagagaagccagcaggcugugaucccgaacauuggcucucggccccgcgucagaaauaucccuucccggaucagcauuuacuggaccaucgugaaacccggggacauucugcugaucaacuccaccggaaaucucauugccccucgcggcuacuucaagaucagaucugggcggagcuccaucaugcgcagcgacgcucccauuggaaaauguaacucugagugcaucacaccgaauggcuccauuccuaacgauaagcccuuucagaaugugaacagaaucacguauggcgccuguccucgguacgucaagcaaaauacccugaaacuugcgacagggaugcgcaacguucccgaaaagcagaccagaggaauuuucggcgccaucgcuggguuuaucgagaauggaugggagggcaugguggacgggugguauggauuccggcaccagaacagcgaaggcagaggccaagccgcugaucugaaaucuacacaggccgccauugaccagaucaaugggaagcucaaccgccugauuggaaaaaccaacgagaaguuccaccagaucgaaaaagaguuuagcgaaguggagggccggauucaagaucuugagaaguacgucgaagacacgaagaucgaucugugguccuauaaugcugagcuccugguggcgcuggaaaaccagcauacaauugaccucaccgauucugagaugaauaaacuguucgaaaagaccaaaaagcagcuuagagagaacgccgaggacauggggaauggaugcuuuaaaaucuaccacaagugugauaacgcuugcaucggcagcauucgcaaugggacauaugaccaugacguuuaccgggaugaagcccugaacaauagauuccagaucaagggcguggagcucaaauccggauacaaggacuggauucuguggaucagcuuugccauuucuugcuuccuucugugugucgcucuccugggcuuuaucaugugggccugccaaaaagggaacauccgcuguaauauuugcaucuga

SEQ ID NO: 193443 - RNA, 1701 nt, Artificial Sequence
  derived and/or modified sequence opt5 from hemagglutinin__InfluenzaA__AGT18756
augaagaccaucauugcccugagcuacgugcucugccuggucuucgcucagaaacuucccggcaacgacaauuccacagccacgcugugucucgggcaccaugcgguuccuaacggaaccaucgugaagacaauuaccaaugauagaaucgaggugacaaacgcuaccgaacugguccaaaauucuagcauuggcgagaucugcgacuccccgcaccagauccuugauggggaaaacuguacacugauugacgcccuccugggagauccccagugcgacgauuuucagaauaaaaagugggaccuguucguggagcggucuaaagccuauagcaacuguuacccuuaugauguucccgacuacgcuucccuccgcucucugguggccagcuccggcacccuugaauuuaauaacgagagcuucaauugggcuggggucacgcaaaacggaaccucuuccgccugcagacggggcagcaauucuuccuuuuucagccgccugaacuggcucacacaucugaauuuuaaguauccugcgcuuaacgugaccaugcccaacaaugagcaguucgauaagcuguacaucuggggcguucaccauccugggacagacaaagaucagauuuuucucuaugcccagucuuccggaagaaucaccgugagcacgaagcggucccaacaggcugucauuccgaacaucggcucucgcccccggauuagaaauaucccuagccgcaucuccauuuacuggacaaucgugaaacccggggacauucugcugaucaacagcaccggaaaucucauugccccuagaggcuacuucaagauccggucugggaaauccagcaucaugcgcucugacgcucccauuggaaaguguaagagcgaaugcaucacaccgaacggcuccauuccuaaugauaaacccuuucagaacgugaauagaaucaccuauggcgccuguccucgguacgucaagcagucuacccugaaacuugcgacagggaugcgcaacguucccgagaagcaaacgagaggaauuuucggcgccaucgcuggguuuaucgaaaauggaugggagggcaugguggacgggugguauggauuccggcaccagaacagcgagggcagaggccaggccgcugaucugaaauccacccaagccgccauugaccagaucaaugggaagcucaaccgccugauuggaaaaacaaaugaaaaguuccaccagaucgagaaggaauuuagcgagguggaaggccggauucaggaucuugagaaauacgucgaggacaccaagaucgaucuguggucuuauaaauccgaacuccugguggcucuggagaaccaacauacaauugaccucaccgauagcgaaaugaacaagcuguucgagaaaacgaagaagcagcuuagagaaaaugcggaggacauggggaacggaugcuuuaaaaucuaccacaagugugauaaugccugcaucggcucuauucgcaacgggacauaugaccaugacguuuaccgggaugaggcucugaauaacagauuccagaucaaaggcguggaacucaaguccggauacaaagacuggauucuguggaucagcuuugccauuuccugcuuccuucugugugucgcccuccugggcuuuaucaugugggcuugccagaaggggaauauccgcuguaacauuugcaucuga

SEQ ID NO: 193444 - RNA, 1701 nt, Artificial Sequence
  derived and/or modified sequence opt5 from hemagglutinin__InfluenzaA__AGT18757
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagagcuucaauugggcuggggugacgcaaaacggaaccucuuccgccugcagacggggcagcaauucuuccuuuuucagccgccugaacuggcucacacaucugaauuuuaaguauccugcgcuuaacgucaccaugcccaacaaugagcaguucgauaagcuguacauuuggggcgugcaccauccugggacagacaaagaucagaucuuucucuaugcccagucuuccggaagaauuaccguuagcacgaagcggucccaacaggcugugaucccgaacauuggcucucgccccagaauccggaauaucccuagccgcauuuccaucuacuggacaauugucaaacccggggacauccugcugauuaacagcaccggaaaucucaucgccccuagaggcuacuucaagauccggucugggaaauccagcauuaugcgcucugacgcucccaucggaaaguguaagagcgaaugcauuacaccgaacggcuccaucccuaaugauaaacccuuucagaacgugaauagaauuaccuauggcgccuguccucgguacgugaagcagucuacccugaaacuugcgacagggaugcgcaacguccccgagaagcaaacgagaggaaucuucggcgccaucgcuggguuuauugaaaauggaugggagggcaugguugacgggugguauggauuccggcaccagaacagcgagggcagaggccaggccgcugaucugaaauccacccaagccgccaucgaccagauuaaugggaagcucaaccgccugaucggaaaaacaaaugaaaaguuccaccagauugagaaggaauuuagcgagguggaaggccggauccaggaucuugagaaauacguggaggacaccaagauugaucuguggucuuauaacgcugaacuccuggucgcgcuggagaaccaacauacaaucgaccucaccgauuccgaaaugaauaaacuguucgagaagacgaaaaagcagcuuagagaaaacgccgaggacauggggaauggaugcuuuaagaucuaccacaaaugugauaacgcuugcauuggcagcauccgcaaugggacauaugaccaugacguguaccgggaugaggcccugaacaauagauuccagauuaagggcguugaacucaaaucuggauacaaggacuggauccuguggauuuccuuugccaucagcugcuuccuucuguguguggcucuccugggcuuuaucaugugggccugccagaaagggaacauucgcuguaauaucugcauuuga

SEQ ID NO: 193445 - RNA, 1701 nt, Artificial Sequence
  derived and/or modified sequence opt5 from hemagglutinin__InfluenzaA__AGT18758
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagagcuucaauugggcuggggugacgcaaaacggaaccucuuccgccugcagacggggcagcaauucuuccuuuuucagccgccugaacuggcucacacaucugaauuuuaaguauccugcgcuuaacgucaccaugcccaacaaugagcaguucgauaagcuguacauuuggggcgugcaccauccugggacagacaaagaucagaucuuucucuaugcccagucuuccggaagaauuaccguuagcacgaagcggucccaacaggcugugaucccgaacauuggcucucgccccagaauccggaauaucccuagccgcauuuccaucuacuggacaauugucaaacccggggacauccugcugauuaacagcaccggaaaucucaucgccccuagaggcuacuucaagauccggucugggaaauccagcauuaugcgcucugacgcucccaucggaaaguguaagagcgaaugcauuacaccgaacggcuccaucccuaaugauaaacccuuucagaacgugaauagaauuaccuauggcgccuguccucgguacgugaagcagucuacccugaaacuugcgacagggaugcgcaacguccccgagaagcaaacgagaggaaucuucggcgccaucgcuggguuuauugaaaauggaugggagggcaugguugacgggugguauggauuccggcaccagaacagcgagggcagaggccaggccgcugaucugaaauccacccaagccgccaucgaccagauuaaugggaagcucaaccgccugaucggaaaaacaaaugaaaaguuccaccagauugagaaggaauuuagcgagguggaaggccggauccaggaucuugagaaauacguggaggacaccaagauugaucuguggucuuauuccagcgaacuccuggucgcucuggagaaccaacauacaaucgaccucaccgauucugaaaugaacaaacuguucgagaagacgaaaaagcagcuuagagaaaaugcggaggacauggggaacggaugcuuuaagaucuaccacaaaugugauaauacaugcauuggcuccauccgcaacgggaccuaugaccaugacguguaccgggaugaggcccugaauaacagauuccagauuaagggcguugaacucaaaagcggauacaaggacuggauccuguggauuuccuuugcuaucucuugcuuccuugugugugucgcccugcucggcuuuaucaugugggccugccagaaagggaauauucgcuguaacaucugcauuuga

SEQ ID NO: 193446 - RNA, 1701 nt, Artificial Sequence
  derived and/or modified sequence opt5 from hemagglutinin__InfluenzaA__AGT18759
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagagcuucaauugggcuggggugacgcaaaacggaaccucuuccgccugcagacggggcagcaauucuuccuuuuucagccgccugaacuggcucacacaucugaauuuuaaguauccugcgcuuaacgucaccaugcccaacaaugagcaguucgauaagcuguacauuuggggcgugcaccauccugggacagacaaagaucagaucuuucucuaugcccagucuuccggaagaauuaccguuagcacgaagcggucccaacaggcugugaucccgaacauuggcucucgccccagaauccggaauaucccuagccgcauuuccaucuacuggacaauugucaaacccggggacauccugcugauuaacagcaccggaaaucucaucgccccuagaggcuacuucaagauccggucugggaaauccagcauuaugcgcucugacgcucccaucggaaaguguaagagcgaaugcauuacaccgaacggcuccaucccuaaugauaaacccuuucagaacgugaauagaauuaccuauggcgccuguccucgguacgugaagcagucuacccugaaacuugcgacagggaugcgcaacguccccgagaagcaaacgagaggaaucuucggcgccaucgcuggguuuauugaaaauggaugggagggcaugguugacgggugguauggauuccggcaccagaacagcgagggcagaggccaggccgcugaucugaaauccacccaagccgccaucgaccagauuaaugggaagcucaaccgccugaucggaaaaacaaaugaaaaguuccaccagauugagaaggaauuuagcgagguggaaggccggauccaggaucuugagaaauacguggaggacaccaagauugaucuguggucuuauuccagcgaacuccuggucgcucuggagaaccaacauacaaucgaccucaccgauucugaaaugaacaaacuguucgagaagacgaaaaagcagcuuagagaaaaugcggaggacauggggaacggaugcuuuaagaucuaccacaaaugugauaaugccugcauuggcuccauccgcaacgggacauaugaccaugacguguaccgggaugaggcucugaauaacagauuccagauuaagggcguugaacucaaaagcggauacaaggacuggauccuguggauuuccuuugccaucucuugcuuccuugugugugucgcccugcucggcuuuaucaugugggcuugccagaaagggaauauucgcuguaacaucugcauuuga

SEQ ID NO: 193447 - RNA, 1701 nt, Artificial Sequence
  derived and/or modified sequence opt5 from hemagglutinin__InfluenzaA__AGT18760
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggaacaaagccuauucuaauuguuacccuuaugaugugcccgacuacgcuagccuccgcucccugguugccucuagcggcacccuugaauuuaacaaugaguccuucaacugggcuggggugacgcaaaauggaaccagcucugccugcagacggggcuccaacagcuccuuuuucucucgccugaauuggcucacacaucugaacuuuaaguauccugcgcuuaacgucaccaugcccaauaacgagcaguucgauaagcuguacauuuggggcgugcaccauccugggacagacaaagaucagaucuuucucuaugcccagagcucuggaagaauuaccguuuccacgaagcggagccaacaggcugugaucccgaauauuggcucccgccccagaauccggaacaucccuucucgcauuagcaucuacuggacaauugucaaacccggggacauccugcugauuaauuccaccggaaaccucaucgccccuagaggcuacuucaagauccggagcgggaaaucuuccauuaugcgcagcgacgcucccaucggaaaguguaagucugaaugcauuacaccgaauggcagcaucccuaacgauaaacccuuucagaaugugaacagaauuaccuauggcgccuguccucgguacgugaagcaguccacccugaaacuugcgacagggaugcgcaauguccccgagaagcaaacgagaggaaucuucggcgccaucgcuggguuuauugaaaacggaugggagggcaugguugacgggugguauggauuccggcaccaaaauucugagggcagaggccaggccgcugaucugaaaagcacccaggccgccaucgaccagauuaacgggaagcucaaucgccugaucggaaaaacaaacgaaaaguuccaccagauugagaaggaauuuuccgagguggaaggccggauccaggaucuugagaaauacguggaggacaccaagauugaucuguggagcuauaaaucugaacuccuggucgcucuggagaaccaacauacaaucgaccucaccgauuccgaaaugaauaagcuguucgagaaaacgaagaagcagcuuagagaaaacgcggaggacauggggaauggaugcuuuaaaaucuaccacaagugugauaacgccugcauuggcagcauccgcaaugggacauaugaccaugacguguaccgggaugaggcucugaacaauagauuccagauuaaaggcguugaacucaagucuggauacaaagacuggauccuguggauuuccuuugccaucagcugcuuccuugugugugucgcccugcucggcuuuaucaugugggcuugccagaaggggaacauucgcuguaauaucugcauuuga

SEQ ID NO: 193448 - RNA, 1701 nt, Artificial Sequence
  derived and/or modified sequence opt5 from hemagglutinin__InfluenzaA__AGT18761
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaaauucuagcaucggcgagaucugcgacuccccgcaccagauucuugauggggaaaacuguacacugaucgacgcccuccugggagauccccagugcgacgauuuucagaauaaaaagugggaccuguucgucgagcggucuaaagccuauagcaacuguuacccuuaugaugugcccgacuacgcuucccuccgcucucugguugccagcuccggcacccuugaauuuaauaacgagagcuucaauugggcuggggugacgcaaaacggaaccucuuccgccugcagacggggcagcaauucuuccuuuuucagccgccugaacuggcucacacaucugaauuuuaaguauccugcgcuuaacgucaccaugcccaacaaugagcaguucgauaagcuguacauuuggggcgugcaccauccugggacagacaaagaucagaucuuucucuaugcccagucuuccggaagaauuaccguuagcacgaagcggucccaacaggcugugaucccgaacauuggcucucgccccagaauccggaauaucccuagccgcauuuccaucuacuggacaauugucaaacccggggacauccugcugauuaacagcaccggaaaucucaucgccccuagaggcuacuucaagauccggucugggaaauccagcauuaugcgcucugacgcucccaucggaaaguguaagagcgaaugcauuacaccgaacggcuccaucccuaaugauaaacccuuucagaacgugaauagaauuaccuauggcgccuguccucgguacgugaagcagucuacccugaaacuugcgacagggaugcgcaacguccccgagaagcaaacgagaggaaucuucggcgccaucgcuggguuuauugaaaauggaugggagggcaugguugacgggugguauggauuccggcaccagaacagcgagggcagaggccaggccgcugaucugaaauccacccaagccgccaucgaccagauuaaugggaagcucaaccgccugaucggaaaaacaaaugaaaaguuccaccagauugagaaggaauuuagcgagguggaaggccggauccaggaucuugagaaauacguggaggacaccaagauugaucuguggucuuauuccagcgaguuccucgucgcucuggaaaaccaacauacaaucgaccugaccgauucugaaaugaacaaacucuuugagaagacgaaaaagcagcugagagaaaaugcggaggacauggggaacggaugcuucaagaucuaccacaaaugugauaaugccugcauuggcuccauccgcaacgggacauaugaccaugacguguaccgggaugaggcucuuaauaacagauuucagauuaagggcguugaacugaaaagcggauacaaggacuggauccucuggauuuccuucgccaucucuugcuuucuggugugugucgcccuucugggcuucaucaugugggcuugccagaaagggaauauucgcuguaacaucugcauuuga

SEQ ID NO: 193449 - RNA, 1701 nt, Artificial Sequence
  derived and/or modified sequence opt5 from hemagglutinin__InfluenzaA__AGT37102
auggaggccaagcuggugguccucuucugcgcuuuuaccacacugaaagccgacaucauuuguguuggcuaccacgcgaacaauagcacggauaccguggacacaaucauggaaaagaacgugaccgucacacauuccgugaaucuucuggagaacucucacaaugggaaacucugcagccugaacggaaaggcuccccuucagcugggcaauuguaacguugccggguggauucucggaaauccugaaugcgaucugcugcucaccgccaacuccuggucuuauaucauugagacaagcuccucuaaaaauggcaccuguuacccgggggaauuuagcgacuaugaggagcugagagaacuucuguccacggugagcucuuucgagcgguucgaaaucuuucccaaggcuaccuccuggccuaaccaugagacaaccaagggagccacaaucgcuugcagccacucuggcgccuccagcuucuaccgcaaucuccuguggauugucaaaaagggcaacucuuaucccaaaaucuccaagagcuacaccaauaacagagggaaagaggugcuuguuauuuggggagugcaucacccucccacggauuccucucaacaggcgcuguaucagaacacacacaccuacaucagcgucggcuccagcaaguacuaucagcgguuuacaccugugguggccgcucgcccgaagauuagagaacaagaggggcggaugaauuacuauuggacccuccuggaacagggagacaccaucacauucgaggccacgggcaaccugauugcucccugguacgccuuugcgcucgauauggggucuuccagcggaaucauggucucugacgccccuguucauaauuguaccacaaaaugccagacaccccacggcgcucugaaaagcaaccuuccuuuccagaaugugcaucccaucaccauuggcgaauguccgaaauaugugaaguccacccaacugcgcauggccacggggcucagaaacaucccuucuauucagagccggggacuguuuggcgcuaucgccggguucauugagggaggcuggacagggaugaucgauggaugguacggcuaucaccaccagaaugagcagggcuccggguacgccgcugaccagaaaagcacccaaaucgcgauugauggaaucucuaacaaggucaauuccauuaucgaaaagaugaacgugcaguuuaccagcguuggcaaggaguucaaugaccuugaaaagcgcauugagaaccugaauaaaaagguggaugacggguuccucgacgucuggacauacaacgccgaacugcuggugcuccuggagaaugagagaacccuugauuuucaugacuucaacguuaaaaaccuguaugaaaaggugaaaucucaacuccggaauaacgcuaaggagaucggaaauggcugcuuugaguucuaccacaagugugauaacgaaugcauggaaaaugucaaaaacgggacauauaauuaccccaaguauuccgaggagagcaaacugaaccgcgaaaagaucgacggcgugaaacuugaguccauuggaguccaucagauccuggccauuuacucuacgguggccagcucccucguucugcuggugucucucggcgcuaucagcuuuuggaugugcuccaaugggagccugcaguguagaauuugcaucuga

SEQ ID NO: 193450 - RNA, 1701 nt, Artificial Sequence
  derived and/or modified sequence opt5 from hemagglutinin__InfluenzaA__AGU01877
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauuaauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccacaaccgaccaacagucucucuaccagaaugccgaugcuuacguguucgugggcacgagcagauauuccaagaaauuuaagccugagauugccauccggccgaaaguccgcgaccaggaggggagaaugaacuacuauuggacacugauugaacccggagauaagaucaccuucgaggcuacaggcaaccugguugugccucgguacgccuuugcgauggaacgcaaugccgggagcggaauuaucaucucugacacccccgugcaugauugcaacaccacaugucaaacgccugagggcgcuauuaauaccucccuccccuuccagaacauccacccgauuacaaucggcaaaugcccuaaguaugucaagagcaccaaacugagacuugccacagggcugcggaaugugcccucuauucagagccgcggacucuuuggcgcuaucgccggguucaucgaaggaggcuggaccgggaugguugacggaugguacggcuaucaucaccagaacgagcaaggcuccggguacgccgcugaccugaagucuacgcagaaugcgauugauaaaaucacaaacaaggugaauagcgucauugagaaaaugaacacccaguuuaccgccgugggaaaggaguucaaucaccuugagaagagaaucgaaaaccugaauaaaaagguugacgauggcuuccucgacauuuggacauacaacgcugagcugcuggugcuccuggaaaaugagcggacccuugauuaucaugacuccaacgucaaaaaccuguacgagaaggugcgcaaucagcucaaaaacaaugccaaggaaaucgggaacggauguuuugaguucuaucacaagugcgauaauacauguauggaaagcgucaaaaacggcacguacgacuauccuaaguacucugaggaagccaaacugaauagagagaagaucgauggggugaaacuugaguccacccggauuuaucaaauccuggcuauuuacagcacaguugccucuucccucgugcuggucgugagccugggcgcgaucuccuuuuggaugugcucuaacggaagccuccagugccgcauuuguaucuga
